US012227746B2

(12) United States Patent
Jafar-Nejad

(10) Patent No.: US 12,227,746 B2
(45) Date of Patent: Feb. 18, 2025

(54) COMPOUNDS AND METHODS FOR MODULATING SCN2A

(71) Applicant: Ionis Pharmaceuticals, Inc., Carlsbad, CA (US)

(72) Inventor: Paymaan Jafar-Nejad, Carlsbad, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 18/483,663

(22) Filed: Oct. 10, 2023

(65) Prior Publication Data

US 2024/0102012 A1    Mar. 28, 2024

Related U.S. Application Data

(63) Continuation of application No. 18/017,276, filed as application No. PCT/US2021/044887 on Aug. 6, 2021, now abandoned.

(60) Provisional application No. 63/063,120, filed on Aug. 7, 2020.

(51) Int. Cl.
*C12N 15/113*    (2010.01)
*A61P 25/00*    (2006.01)

(52) U.S. Cl.
CPC ............ *C12N 15/113* (2013.01); *A61P 25/00* (2018.01); *C12N 2310/11* (2013.01); *C12N 2310/315* (2013.01); *C12N 2310/322* (2013.01); *C12N 2310/3231* (2013.01); *C12N 2310/341* (2013.01)

(58) Field of Classification Search
CPC .............. C12N 15/113; C12N 2310/11; C12N 2310/315; C12N 2310/322; C12N 2310/3231; C12N 2310/341
See application file for complete search history.

(56) References Cited

U.S. PATENT DOCUMENTS

| | | |
|---|---|---|
| 3,687,808 A | 8/1972 | Clercq et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohtsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan et al. |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,185,444 A | 2/1993 | Summerton et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,276,019 A | 1/1994 | Cohen et al. |
| 5,286,717 A | 2/1994 | Cohen et al. |

(Continued)

FOREIGN PATENT DOCUMENTS

| | | |
|---|---|---|
| WO | 2003/060525 A1 | 7/2003 |
| WO | 2004/016754 A2 | 2/2004 |

(Continued)

OTHER PUBLICATIONS

De Lera Ruiz et al. Journal of Medicinal Chemistry 58, 7093-7118 (Year: 2015).*
Evers et al. Advanced Drug Delivery Reviews 87, 90-103 (Year: 2015).*
Schwarz et al., Clinical and genetic spectrum of SCN2A-associated episodic ataxia. Eur J Paediatr Neurol. May 2019;23(3):438-447.
International Search Report and Written Opinion for Application No. PCT/US2021/044887, dated Jan. 28, 2022, 11 pages.
Berret et al., Oligodendroglial excitability mediated by glutamatergic inputs and Nav1.2 activation. Nat Commun. Sep. 15, 2017;8(1):557, 15 pages.

(Continued)

*Primary Examiner* — Brian Whiteman
(74) *Attorney, Agent, or Firm* — McCarter & English, LLP; Yelena Margolin; Dylan M. Blumenthal

(57) ABSTRACT

Provided are compounds, methods, and pharmaceutical compositions for reducing the amount or activity of SCN2A RNA in a cell or subject, and in certain instances reducing the amount of SCN2A protein in a cell or subject. Such compounds, methods, and pharmaceutical compositions are useful to ameliorate at least one symptom or hallmark of a disease or disorder associated with a voltage-gated sodium channel protein, such as, for example, a Developmental and Epileptic Encephalopathy, an intellectual disability, or an autism spectrum disorder. Such symptoms and hallmarks include, but are not limited to, seizures, hypotonia, sensory integration disorders, motor development delays and dysfunctions, intellectual and cognitive dysfunctions, movement and balance dysfunctions, visual dysfunctions, delayed language and speech, gastrointestinal disorders, neurodevelopmental delays, sleep problems, and sudden unexpected death in epilepsy.

26 Claims, No Drawings

Specification includes a Sequence Listing.

(56) References Cited

U.S. PATENT DOCUMENTS

| | | |
|---|---|---|
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Summerton et al. |
| 5,405,939 A | 4/1995 | Suhadolnik et al. |
| 5,432,272 A | 7/1995 | Benner |
| 5,434,257 A | 7/1995 | Matteucci et al. |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmeiner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Buhr et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Misiura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci et al. |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bischofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci et al. |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Buhr et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'o et al. |
| 6,005,087 A | 12/1999 | Cook et al. |
| 6,005,096 A | 12/1999 | Matteucci et al. |
| 6,166,199 A | 12/2000 | Cook et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,770,748 B2 | 8/2004 | Imanishi et al. |
| 7,015,315 B1 | 3/2006 | Cook et al. |
| 7,053,207 B2 | 5/2006 | Wengel |
| 7,101,993 B1 | 9/2006 | Cook et al. |
| 7,262,177 B2 | 8/2007 | Ts'O et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Seth et al. |
| 7,750,131 B2 | 7/2010 | Seth et al. |
| 7,875,733 B2 | 1/2011 | Bhat et al. |
| 7,939,677 B2 | 5/2011 | Bhat et al. |
| 8,022,193 B2 | 9/2011 | Seth et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,143,005 B2 | 3/2012 | Rouleau et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 9/2015 | Prakash et al. |
| 9,290,760 B2 | 3/2016 | Rajeev et al. |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2005/0130923 A1 | 6/2005 | Bhat et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |
| 2010/0190837 A1 | 7/2010 | Migawa et al. |
| 2010/0197762 A1 | 8/2010 | Swayze |
| 2013/0130378 A1 | 5/2013 | Manoharan et al. |
| 2014/0107330 A1 | 4/2014 | Freier et al. |

(56) References Cited

U.S. PATENT DOCUMENTS

| | | |
|---|---|---|
| 2015/0018540 A1 | 1/2015 | Prakash et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2019/0192691 A1 | 6/2019 | Barrett et al. |
| 2024/0026353 A1 | 1/2024 | Jafar-Nejad et al. |

FOREIGN PATENT DOCUMENTS

| | | |
|---|---|---|
| WO | 2004/045543 A2 | 6/2004 |
| WO | 2005/116204 A1 | 12/2005 |
| WO | 2016/027168 A2 | 2/2016 |
| WO | 2019/084050 A1 | 5/2019 |
| WO | 2019/143831 A1 | 7/2019 |
| WO | 2020/041348 A1 | 2/2020 |
| WO | 2020/154462 A1 | 7/2020 |
| WO | 2020/227406 A1 | 11/2020 |
| WO | 2022/032060 A2 | 2/2022 |

OTHER PUBLICATIONS

Branch, A good antisense molecule is hard to find. Trends Biochem Sci. Feb. 1998;23(2):45-50.

Chin, On the Preparation and Utilization of Isolated and Purified Oligonucleotides. University of North Carolina School of Law. 1 page, Mar. 9, 2002.

Cooke, Antisense Drug Technology, Principles, Strategies, and Application, Second Edition. CRC Press. pp. 414, (2008).

Cooke, Basic Principles of Antisense Therapeutics. Antisense Research and Application. Chapter 1, pp. 1-50, (1998).

Egli et al., Synthesis, improved antisense activity and structural rationale for the divergent RNA affinities of 3'-fluoro hexitol nucleic acid (FHNA and Ara-FHNA) modified oligonucleotides. J Am Chem Soc. Oct. 19, 2011;133(41):16642-9.

Gautschi et al., Activity of a novel bcl-2/bcl-xL-bispecific antisense oligonucleotide against tumors of diverse histologic origins. J Natl Cancer Inst. Mar. 21, 2001;93(6):463-71.

Heintz, Bac to the future: the use of bac transgenic mice for neuroscience research. Nat Rev Neurosci. Dec. 2001;2(12):861-70.

Li et al., Antisense Oligonucleotide Therapy for Scn2a Gain-of-function Epilepsies. Society for Neuroscience, Chicago, IL. 1 page, poster presentation, Oct. 19-23, 2019.

Li et al., Antisense oligonucleotide therapy for SCN2A gain-of-function epilepsy. bioRxiv, doi:https://doi.org/10.1101/2020.09.09.289900. 28 pages, Sep. 11, 2020.

Li et al., Antisense oligonucleotide therapy reduces seizures and extends life span in an SCN2A gain-of-function epilepsy model. J Clin Invest. Dec. 1, 2021;131(23):e152079, 13 pages.

Maher et al., Comparative hybrid arrest by tandem antisense oligodeoxyribonucleotides or oligodeoxyribonucleoside methylphosphonates in a cell-free system. Nucleic Acids Res. Apr. 25, 1988;16(8):3341-58.

New England BioLabs, Inc., Nucleic Acids, Linkers and Primers. Catalog, pp. 121, 284, 1998/1999.

Reynolds et al., Rational siRNA design for RNA interference. Nat Biotechnol. Mar. 2004;22(3):326-30.

Sanders et al., Progress in Understanding and Treating SCN2A-Mediated Disorders. Trends Neurosci. Jul. 2018;41(7):442-456.

Sanghvi, Heterocyclic Base Modifications in Nucleic Acids and Their Applications in Antisense Oligonucleotides. Antisense Research and Applications, Chapter 15. CRC Press, Boca Raton. Stanley T. Crooke (Ed.). pp. 273-288, (1993).

Seth et al., Short antisense oligonucleotides with novel 2'-4' conformationaly restricted nucleoside analogues show improved potency without increased toxicity in animals. J Med Chem. Jan. 8, 2009;52(1):10-3.

Wolff et al., Genetic and phenotypic heterogeneity suggest therapeutic implications in SCN2A-related disorders. Brain. May 1, 2017;140(5):1316-1336.

Wolff et al., Phenotypic spectrum and genetics of SCN2A-related disorders, treatment options, and outcomes in epilepsy and beyond. Epilepsia. Dec. 2019;60 Suppl 3:S59-S67.

Woolf et al., Specificity of antisense oligonucleotides in vivo. Proc Natl Acad Sci U S A. Aug. 15, 1992;89(16):7305-9.

\* cited by examiner

COMPOUNDS AND METHODS FOR MODULATING SCN2A

CROSS-REFERENCE TO RELATED APPLICATIONS

This application is a Continuation Application of U.S. patent application Ser. No. 18/017,276, filed on Jan. 20, 2023; which is a 35 U.S.C. § 371 national stage filing of International Application No. PCT/US2021/044887, filed on Aug. 6, 2021; which, in turn, claims the benefit of U.S. Provisional Application No. 63/063,120, filed on Aug. 7, 2020. The entire contents of each of the foregoing applications are expressly incorporated herein by reference.

SEQUENCE LISTING

The present application is being filed along with a Sequence Listing in electronic format. The Sequence Listing is provided as a file entitled 137486-07203.xml, created on Oct. 3, 2023, which is 3,508,610 bytes in size. The information in the electronic format of the sequence listing is incorporated herein by reference in its entirety.

FIELD

Provided are compounds, methods, and pharmaceutical compositions for reducing the amount or activity of SCN2A RNA in a cell or subject, and in certain instances reducing the amount of SCN2A protein in a cell or subject. Such compounds, methods, and pharmaceutical compositions are useful to ameliorate at least one symptom or hallmark of a disease or disorder associated with a voltage-gated sodium channel protein, such as, for example, a Developmental and Epileptic Encephalopathy, an intellectual disability, or an autism spectrum disorder. Such symptoms and hallmarks include, but are not limited to seizures, hypotonia, sensory integration disorders, motor development delays and dysfunctions, intellectual and cognitive dysfunctions, movement and balance dysfunctions, visual dysfunctions, delayed language and speech, gastrointestinal disorders, neurodevelopmental delays, sleep problems, and sudden unexpected death in epilepsy.

BACKGROUND

The human gene SCN2A encodes human SCN2A protein, the alpha-1 subunit of the voltage-gated sodium channel NaV1.2. Mutations in SCN24 are associated with a variety of neurodevelopmental and intellectual diseases and disorders, such as Developmental and Epileptic Encephalopathies (DEE), including Early Seizure Onset Epileptic Encephalopathy (EE), Late Seizure Onset Epileptic Encephalopathy, and Benign Familial Neonatal-Infantile Seizures (BFNIS): mutations in SCN2A are also associated with intellectual disability (ID) and/or autism spectrum disorder (ASD), with or without seizures (Wolff, M., et al., 2019, Epilepsia 60, S59-S67; Sanders, S., et al., 2018, Trends in Neurosciences 41, 442-456; Wolff, M., et al., 2017, Brain 140, 1.316-1336). DEEs include a broad range of diseases that include neonatal and early infantile. DEE, for example Ohtahara Syndrome and epilepsy with migrating focal seizures of infancy (EIMFS); infantile and childhood DEE, for example West Syndrome and Lennon-Gastaut Syndrome; Dravet Syndrome; Idiopathic/Generic Generalized Epilepsies (IGE/GGE); Temporal Lobe Epilepsy; Myoclonic Astatic Epilepsy (MAE); Migrating Partial Epilepsy of Infancy (MMPSI); and familial hemiplegic migraines, with or without epilepsy (Wolff, M. et al., 2019; Harkin, L. A., et at, 2007, Brain 130, 843-852; Escayg, A., et al., 2010, Epilepsia 51, 1650-1658; Miller I. O. et al., 2007 Nov. 29 [Updated 2019 Apr. 18]. In Adam M P, Ardinger R H, Pagon R A., et al., editors. GeneReviews® [Internet]. Seattle (WA): University of Washington, Seattle: 1993-2020. Available from: www.ncbi.nlm.nih.gov/books/NBK1318/).

Symptoms and hallmarks associated with DEEs include seizures, hypotonia, sensory integration disorders, motor development delays and dysfunctions, intellectual and cognitive dysfunctions, movement and balance dysfunctions, visual dysfunctions, delayed language and speech, gastrointestinal disorders, neurodevelopmental delays, sleep problems, and sudden unexpected death in epilepsy. Seizures include focal, clonic, tonic, and generalized tonic and clonic seizures, prolonged seizures (often lasting longer than 10 minutes), and frequent seizures (for example, convulsive, myoclonic, absence, focal, obtundation status, and tonic seizures) (Guzzetta, F., 2011, Epilepsia 52:S2, 35-38; Anwar et al., 2019, Cureus 11, e5006, Wolff et al., 2019). Symptoms and hallmarks associated with ID and ASD include motor development delays, delayed social and language milestones, repetitive actions, uncoordinated oral movements, gastrointestinal disorders, sleep problems, and seizures (Wolff et al., 2019).

Currently there is a lack of acceptable options for treating DEEs such as EEs, Late Onset EEs, and BFNIS; and for treating ID and ASD. It is therefore an object herein to provide compounds, methods, and pharmaceutical compositions for the treatment of such diseases and disorders.

SUMMARY OF THE INVENTION

Provided herein are compounds, methods, and pharmaceutical compositions for reducing the amount or activity of SCN2A RNA, and in certain embodiments reducing the expression of SCN2A protein in a cell or subject. In certain embodiments, the subject has a disease or disorder associated with a voltage-gated sodium channel protein. In certain embodiments, the voltage-gated sodium channel protein is SCN2A. In certain embodiments, the subject has a disease or disorder associated with a voltage-gated sodium channel protein that is not SCN2A. In certain embodiments, the subject has a disease or disorder associated with SCN1A.

In certain embodiments, the subject has a Developmental or Epileptic Encephalopathy; in certain embodiments, the subject has Early Seizure Onset Epileptic Encephalopathy; in certain embodiments, the subject has Late Seizure Onset Epileptic Encephalopathy; in certain embodiments the subject has Benign Familial Neonatal-Infantile Seizures; in certain embodiments, the subject has an intellectual disability (ID); in certain embodiments, the subject has an autism spectrum disorder (ASD); in certain embodiments, the subject has Dravet Syndrome. In certain embodiments, compounds useful for reducing the amount or activity of SCN2A RNA are oligomeric compounds. In certain embodiments, compounds useful for reducing the amount or activity of SCN2A RNA are modified oligonucleotides. In certain embodiments, compounds useful for reducing expression of SCN2A protein are oligomeric compounds. In certain embodiments, compounds useful for reducing expression of SCN2A protein are modified oligonucleotides.

Also provided are methods useful for ameliorating at least one symptom or hallmark of a Developmental or Epileptic Encephalopathy such as EEs. Late Seizure Onset EEs, and BFNIS; an intellectual disability; or autism spectrum disorder. In certain embodiments, the symptom or hallmark includes seizures, hypotonia, Sensory integration disorders, motor dysfunctions, intellectual and cognitive dysfunctions, movement and balance dysfunctions, visual dysfunctions, delayed language and speech, neurodevelopmental delays, sudden unexpected death in epilepsy, motor development delays, delayed social and language milestones, repetitive actions, uncoordinated oral movements, gastrointestinal disorders (for example, gastroesophageal reflux, diarrhea, constipation, dysmotility, and the like), and sleep problems. In certain embodiments, the seizures include focal, clonic, tonic, and generalized tonic and clonic seizures, prolonged seizures (often lasting longer than 10 minutes), and frequent seizures (for example, convulsive, myoclonic, absence, focal, obtundation status, and tonic seizures).

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included," is not limiting. Also, terms such as "element" or "component" encompass both elements and components comprising one must and elements and components that comprise more than one subunit, unless specifically stated otherwise.

The section headings used herein are for organizational purposes only and are not to be construed as limiting the subject matter described. All documents or portions of documents, cited in this application, including, but not limited to, patents, patent applications, articles, books, treatises, and GenBank, ENSEMBL, and NCBI reference sequence records are hereby expressly incorporated-by-reference for the portions of the document discussed herein, as well as in their entirety.

Definitions

Unless specific definitions are provided, the nomenclature used in connection with and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein. "2'-deoxynucleoside" means a nucleoside comprising a 2'-H(H) deoxyfuranosyl sugar moiety. In certain embodiments, a 2'-deoxynucleoside is a 2'41-D-deoxynucleoside and comprises a 2'-β-D-deoxyribosyl sugar moiety, which has the β-D ribosyl configuration as found in naturally occurring deoxyribonucleic acids (DNA). In certain embodiments, a 2'-deoxynucleoside may comprise a modified nucleobase or may comprise an RNA nucleobase (uracil).

As used herein. "2'-MOE" means a 2'-OCH$_2$CH$_2$OCH$_3$ group in place of the 2'-OH group of a furanosyl sugar moiety. A "2'-MOE sugar moiety" means a sugar moiety with a 2'-OCH$_2$CH$_2$OCH$_3$ group in place of the 2'-OH group of a furanosyl sugar moiety. Unless otherwise indicated, a 2'-MOE sugar moiety is in the β-D-ribosyl configuration. "MOE" means O-methoxyethyl.

As used herein, "2'-MOE nucleoside" means a nucleoside comprising a 2'-MOE sugar moiety.

As used herein, "2'-OMe" means a 2'-OCH$_3$ group in place of the 2'-OH group of a furanosyl sugar moiety. A "2'-O-methyl sugar moiety" or "2'-OMe sugar moiety" means a sugar moiety with a 2'-OCH$_3$ group in place of the 2'-OH group of a furanosyl sugar moiety. Unless otherwise indicated, a 2'-OMe sugar moiety is in the β-D-ribosyl configuration.

As used herein, "2'-OMe nucleoside" means a nucleoside comprising a 2'-OMe sugar moiety.

As used herein "2'-substituted nucleoside" means a nucleoside comprising a 2'-substituted sugar moiety. As used herein, "2'-substituted" in reference to a sugar moiety means a sugar moiety comprising at least one 2-substituent group other than H or OH.

As used herein, "5-methyl cytosine" means a cytosine modified with a methyl group attached to the 3 position. A 5-methyl cytosine is a modified nucleobase.

As used herein, "administering" mans providing a pharmaceutical agent to a subject.

As used herein. "antisense activity" means any detectable and/or measurable change attributable to the hybridization of an antisense compound to its target nucleic acid. In certain embodiments, antisense activity is a decrease or reduction in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity. An antisense compound comprises an antisense oligonucleotide and optionally one or more additional features, such as a conjugate group.

As used herein, "antisense agent" means an antisense compound and optionally one or more additional features, such as a sense compound.

As used herein, "sense compound" means a sense oligonucleotide and optionally one or more additional features, such as a conjugate group.

As used herein, "antisense oligonucleotide" means an oligonucleotide, including the oligonucleotide portion of an antisense compound, that is capable of hybridizing to a target nucleic acid and is capable of at least one antisense activity. Antisense oligonucleotides include but are not limited to antisense RNAi oligonucleotides and antisense RNase H oligonucleotides.

As used herein, "ameliorate" in reference to a treatment means improvement in at least one symptom or hallmark relative to the same symptom or hallmark in the absence of the treatment. In certain embodiments, amelioration is the reduction in the severity or frequency of a symptom or hallmark or the delayed onset or slowing of progression in the severity or frequency of a symptom or hallmark. In certain embodiments, the symptom or hallmark is seizures, hypotonia, sensory integration disorders, motor dysfunctions, intellectual and cognitive dysfunctions, movement and balance dysfunctions, visual dysfunctions, delayed language and speech, neurodevelopmental delays, sudden unexpected death in epilepsy, motor development delays, delayed social and language milestones, repetitive actions, uncoordinated oral movements, gastrointestinal disorders (for example, gastroesophageal reflux, diarrhea, constipation, dysmotility, and the like), or sleep problems. In certain embodiments, the seizures are focal, clonic, tonic, and generalized tonic and clonic seizures, prolonged seizures (often lasting longer than 10 minutes), or frequent seizures (for example, convulsive, myoclonic, absence, focal, obtundation status, or tonic seizures).

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the furanosyl sugar moiety is a ribosyl moiety. In certain embodiments, the bicyclic sugar moiety does not comprise a furanosyl moiety.

As used herein, "bicyclic nucleoside" or "BNA" means a nucleoside comprising a bicyclic sugar moiety. As used herein "cerebrospinal fluid" or "CSF" means the fluid filling the space around the brain and spinal cord. "Artificial cerebrospinal fluid" or "aCSF" means a prepared or manufactured fluid that has certain properties of cerebrospinal fluid.

As used herein "cleavable moiety" means a bond or group of atoms that is cleaved under physiological conditions, for example, inside a cell, an animal, or a human.

As used herein "complementary" in reference to an oligonucleotide means that at least 70% of the nucleobases of the oligonucleotide or MC or more portions thereof and the nucleobases of a another nucleic acid or MC or more portions thereof are capable of hydrogen bonding with one another when the nucleobase sequence of the oligonucleotide and the other nucleic acid are aligned in opposing directions. As used herein, complementary nucleobases means nucleobases that are capable of funning hydrogen bonds with one another. Complementary nucleobase pairs include adenine (A) and thy sine (T), adenine (A) and uracil (U), cytosine (C) and guanine. (G), 5-methyl cytosine (mC) and guanine (G). Complementary oligonucleotides and/or target nucleic acids need no have nucleobase complementarity at each nucleoside. Rather, some mismatches are tolerated. As used herein, "fully complementary" or "100% complementary" in reference to an oligonucleotide, or a portion thereof, means that the oligonucleotide, or portion thereof, is complementary to another oligonucleotide or target nucleic acid at each nucleobase of the shorter of the two oligonucleotides, or at each nucleoside if the oligonucleotides are the same length.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein. "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein. "cEt" means a 4' to 2' bridge in place of the 2'OH-group of a ribosyl sugar moiety, wherein the bridge has the formula of 4'-CH(CH$_3$)—O-2', and wherein the methyl group of the bridge is in the S configuration. A "cEt sugar moiety" is a bicyclic sugar moiety with a 4' to 2' bridge in place of the 2'OH-group of a ribosyl sugar moiety, wherein the bridge has the formula of 4-CH(CH$_3$)—O-2', and wherein the methyl group of the bridge is in the S configuration. "cEt" means constrained ethyl.

As used herein, "cEt nucleoside" means a nucleoside comprising a cEt modified sugar moiety.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the smile particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein "chirally controlled" in reference to an internucleoside linkage means chirality at that linkage is enriched for a particular stereochemical configuration.

As used herein, "deoxy region" means a region of 5-12 contiguous nucleotides, wherein at least 70% of the nucleosides are 2'-β-D-deoxynucleosides. In certain embodiments, each nucleoside is selected from a 2'-β-D deoxynucleoside, a bicyclic nucleoside, and a 2'-substituted nucleoside. In certain embodiments, a deoxy region supports RNase H activity. In certain embodiments, a deoxy region is the gap or internal region of a gapmer.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings" or "wing segments." in certain embodiments, the internal region is a deoxy region. The positions of the internal region or gap refer to the order of the nucleosides of the internal region and are counted starting from the 5'-end of the internal region. Unless otherwise indicated. "gapmer" refers to a sugar motif. In certain embodiments, each nucleoside of the gap is a 2'-β-D-deoxynucleoside. In certain embodiments, the gap comprises one 2'-substituted nucleoside at position 1, 2, 3, 4, or 5 of the gap, and the remainder of the nucleosides of the gap are 2'-β-D-deoxynucleosides. As used herein, the term "MOE gapmer" indicates a gapmer having a gap comprising 2'-β-D-deoxynucleosides and wings comprising 2'-MOE nucleosides. As used herein, the term "mixed wing gapmer" indicates a gapmer having wings comprising modified nucleosides comprising at least two different sugar modifications. Unless otherwise indicated, a gapmer may comprise one or mom modified internucleoside linkages and/or modified nucleobases and such modifications do not necessarily follow the gapmer pattern of the sugar modifications.

As used herein, "hotspot region" is a range of nucleobases on a target nucleic acid that is amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein. "internucleoside linkage" means the covalent linkage between contiguous nucleosides in an oligonucleotide. As used herein, "modified internucleoside linkage" means any internucleoside linkage other than a phosphodiester internucleoside linkage. "Phosphorothioate internucleoside linkage" or "PS internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "LNA" means locked nucleic acid. An "LNA sugar moiety" is a bicyclic sugar moiety with a 4' to 2' bridge in place of the 2'OH-group of a furanosyl sugar moiety, wherein the bridge has the formula of 4'-$CH_2$—O-2'. "LNA" means locked nucleic acid. In some embodiments, the furanosyl sugar moiety is a ribosyl sugar moiety. As used herein, "LNA nucleoside" means a nucleoside comprising a LNA sugar moiety.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "motif" means the pattern of unmodified and/or modified sugar moieties, nucleobases, and/or internucleoside linkages, in an oligonucleotide.

As used herein "nucleobase" means an unmodified nucleobase or a modified nucleobase. As used herein an "unmodified nucleobase" is adenine (A), thymine, (T), cytosine (C), uracil (U), or guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a target nucleic acid or oligonucleotide independent of any sugar or internucleoside linkage modification.

As used herein "nucleoside" means a compound or a fragment of a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein. "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to a subject. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein, "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein, "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein, "prodrug" means a therapeutic agent in a form outside the body that is converted to a different form within a subject or cells thereof. Typically, conversion of a prodrug within the subject is facilitated by the action of an enzymes (e.g., endogenous or viral enzyme) or chemicals present in cells or tissues and/or by physiologic conditions.

As used herein, "reducing the amount," "reducing the activity," "decreasing the amount," or "decreasing the activity" refers to a reduction or blockade of the transcriptional expression or activity relative to the transcriptional expression or activity in an untreated or control sample and does not necessarily indicate a total elimination of transcriptional expression or activity.

As used herein, "RNA" means an RNA transcript and includes pre-mRNA and mature mRNA unless otherwise specified.

As used herein, "RNA/compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RSA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "sell-complementary" in reference to an oligonucleotide means an oligonucleotide that at least partially hybridizes to itself.

As used herein, "standard in vivo assay" means the assay described in Example 1, and reasonable variations thereof.

As used herein, "standard in vivo assay" means the assay described in Example 8 and reasonable variations thereof.

As used herein. "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein. "subject" means a human or non-human animal. In certain embodiments, the subject is a human.

As used herein, "sugar moiety" means an unmodified sugar moiety or a modified sugar moiety. As used herein, "unmodified sugar moiety" means a 2'-OH(H) β-D-ribosyl moiety, as found in RNA (an "unmodified RNA sugar moiety"), or a 2'-OH(H) β-D-deoxyribosyl sugar moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests. In certain embodiments, a hallmark is apparent on a brain MRI scan.

As used herein, "target nucleic acid" and "target RNA" mean a nucleic acid that an antisense compound is designed to affect. Target RNA means an RNA transcript and includes pre-mRNA and mature mRNA unless otherwise specified.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to a subject. For example, a therapeutically effective amount improves a symptom or hallmark of a disease or disorder.

As used herein, "treating" means improving a subject's disease or disorder by administering an oligomeric agent or oligomeric compound described herein. In certain embodiments, treating a subject improves a symptom relative to the same symptom in the absence of the treatment. In certain embodiments, treatment reduces in the severity or frequency of a symptom, or delays the onset of a symptom, slows the progression of a symptom, or slows the severity or frequency of a symptom.

CERTAIN EMBODIMENTS

The present disclosure provides the following non-limiting numbered embodiments:

Embodiment 1

An oligomeric compound comprising a modified oligonucleotide consisting of 12 to 30 linked nucleosides wherein the nucleobase sequence of the modified oligonucleotide is at least 90% complementary to an equal length portion of an SCN2A nucleic acid, and wherein the modified oligonucleotide comprises at least one modification selected from a modified sugar moiety and a modified internucleoside linkage.

Embodiment 2

An oligomeric compound comprising a modified oligonucleotide consisting of 12 to 30 linked nucleosides and having a nucleobase sequence comprising at least 12, at least 13, at least 14, at least 15, at least 16, at least 17, at least 18, at least 19, or 20 contiguous nucleobases of arty of the nucleobase sequences of SEQ NOs: 16-2531, wherein the modified oligonucleotide comprises at least one modification selected from a modified sugar moiety and a modified internucleoside linkage.

Embodiment 3

An oligomeric compound comprising a modified oligonucleotide consisting of 12 to 30 linked nucleosides and having a nucleobase sequence comprising at least 12, at least 13, at least 14, at least 15, at least 16, at least 17, or 18 contiguous nucleobases of any of the nucleobase sequences of SEQ 113 NOs: 2532-2539, wherein the modified oligonucleotide comprises at least one modification selected from a modified sugar moiety and a modified internucleoside linkage.

Embodiment 4

The oligomeric compound of any of embodiments 1 to 3, wherein the modified oligonucleotide is at least 90% complementary to an equal length portion of SEQ ID NO: 2 and is not more than 50% complementary to an equal length portion of SEQ ID NO: 1.

Embodiment 5

An oligomeric compound comprising a modified oligonucleotide consisting of 12 to 30 linked nucleosides, wherein a) the nucleobase sequence of the modified oligonucleotide comprises at least 8, at least 9, at least 10, at least 11, at least 12, at least 13, at least 14, at least 15, at least 16, at least 17, at least 18, at least 19, or at least 20 contiguous nucleobases complementary to an equal length portion of nucleobases 199863-199905, 227493-22755, 243124-243204, 247823-247921, 254142-254177, 168911-168945, 170026-170061, 183519-183562, 188630-188668, 199912-199962, 227419-227450, or 238173-238192 of SEQ ID NO: 2, provided that the modified oligonucleotide does not comprise more than six LNA nucleosides; or
b) in the nucleobase sequence of the modified oligonucleotide comprises at least 8, at least 9, at least 10, at least 11, at least 12, at least 13, at least 14, at least 15, at least 16, at least 17, at least 18, at least 19, or at least 20 contiguous nucleobases complementary to an equal length portion of nucleobases 243917-244073, 170174-170200, 176724-176751, 180772-180801, 183968-184016, 202877-202906, 224198-224217, 224199-224218, or 243918-243937 of SEQ ID NO: 2, wherein the modified oligonucleotides comprises at least one modification selected from a modified sugar moiety and a modified internucleoside linkage.

Embodiment 6

An oligomeric compound comprising a modified oligonucleotide consisting of 12 to 30 linked nucleosides, wherein
a) the nucleobase sequence of the modified oligonucleotide comprises at least 8, at least 9, at least 10, at least 11, at least 12, at least 13, at least 14, at least 15, at least 16, at least 17, at least 18, at least 19, or at least 20 contiguous nucleobases of a sequence selected from SEQ ID NOs: 336, 488, 2021, 2097, 2174, 2250, 2326, 2403, 2499, 2511, 2501, 2502, 2526, 181, 259, 643, 720, 796, 2504, 2505, 2506, 2507, 2508, 2509, 2510, 2511, 2512, 2513, 2514, 2521; 491, 567, 644, 721, 797, 2177, 2253, 2315, 2329, 2406, 2527; 29, 30, 107, 108, 185, 186, 263, 264, 341, 342, 419, 420, 1796, 1871, 1948, 2025, 2101, 2178, 2254, 2330, 2503, 2517, 2522; 1016, 1093, 1104, 1169, 1246, 1323, 1400, 1477, 1554, 1708, 1785, 1860, 1937, 2014, 1631, 2090, 2539; 1896, 485, 561, 638, 715, 791, 868, 22, 47, 2323, 2400; 174, 1328, 1405, 1482, 1559, 1636; 1713, 1790, 1865, 1942, 2019; 20, 98, 253, 332, 410, 1406, 1483, 1560, 16137, 1714, 1791, 1866, 1943; 21, 411, 1407, 1484, 1561, 1638, 1715; 24, 414, 871, 948, 1025, 1100; 25, 337, 415, 490, 566, 2099, 2176, 2252, 2328, 2405; and 182; provided that the modified oligonucleotide does not comprise more than six LNA nucleosides; or
b) wherein the nucleobase sequence of the modified oligonucleotide comprises at least 8, at least 9, at least 10, at least 11, at least 12, at least 13, at least 14, at least 15, at least 16, at least 17, at least 18, at least 19, or at least 20 contiguous nucleobases of a sequence selected from SEQ ID NOs: 1090, 1166, 2484, 2485, 2487, 2493, 2496, 2497, 2498, 2533, 2534, 2535, 2537; 302, 1513, 1667, 1744, 1819, 1896, 1973; 148, 226, 1364, 1441, 1518, 1595, 1672, 1749; 227, 1292, 1369, 1446, 1523, 1600, 1677, 1754, 1829; 228, 1679, 1756, 1831, 1908, 1985, 2061, 2138, 2214, 2290; 1226, 1303, 1380, 1457, 1534, 1611; 2079; 2523; and 2477 wherein the modified oligonucleotide comprises at least one modification selected from a modified sugar moiety and a modified internucleoside linkage.

Embodiment 7

The oligomeric compound of any of embodiments 1-6, comprising a modified oligonucleotide consisting of 12 to 30 linked nucleosides and having a nucleobase sequence comprising at least 12, at least 13, at least 14, at least 15, at least 16, at least 17, at least 18, at least 19, or 20 contiguous nucleobases abases of any of SEQ ID NOs: 2487, 2493, 2510, or 2514.

Embodiment 8

The oligomeric compound of any of embodiments 1-6, comprising a modified oligonucleotide consisting of 12 to 30 linked nucleosides and having a nucleobase sequence comprising at least 12, at least 13, at least 14, at least 15, at least 16, at least 17, or 18 contiguous nucleobases of SEQ ID NO: 2534.

Embodiment 9

The oligomeric compound of any of embodiments 1-8, wherein the modified oligonucleotide has a nucleobase sequence that is at least 80%, at least 85%, at least 90%, at least 95%, or 100% complementary to the nucleobase sequence of SEQ ID NO: 1 or SEQ ID NO: 2 when measured across the entire nucleobase sequence of the modified oligonucleotide.

Embodiment 10

The oligomeric compound of embodiment 9 wherein the modified oligonucleotide is at least 80%, at least 85%, at least 90%, at least 95, or 100% complementary to an intronic region of the nucleobase sequence of SEQ ID NO: 2;
an untranslated region of the nucleobase sequence of SEQ ID NO: 2; or an intron/exon junction region of the nucleobase sequence of SEQ ID NO: 2.

Embodiment 11

The oligomeric compound of arty of embodiments 1-10, wherein the nucleobase sequence of the modified oligonucleotide is no more than 50%, no more than 60%, no more than 70%, no more than 80%, no more than 90%, or no more than 95% complementary to an exonic region of the nucleobase sequence of SEQ ID NO: 2.

Embodiment 12

The oligomeric compound of arty of embodiments 1-11, wherein the modified oligonucleotide consists of 10 to 25, 10 to 30, 10 to 50, 12 to 20, 12 to 25, 12 to 30, 12 to 50, 13 to 20, 13 to 25, 13 to 30, 13 to 50, 14 to 20, 14 to 25, 14 to 30, 14 to 50, 15 to 20, 15 to 25, 15 to 30, 15 to 50, 16 to 18, 16 to 20, 16 to 25, 16 to 30, 16 to 50, 17 to 20, 17 to 25, 17 to 30, 17 to 50, 18 to 20, 18 to 25, 18 to 30, 18 to 50, 19 to 20, 19 to 25, 19 to 30, 19 to 50, 20 to 25, 20 to 30, 20 to 50, 21 to 25, 21 to 30, 21 to 50, 22 to 25, 22 to 30, 22 to 50, 23 to 25.23 to 30, or 23 to 50 linked nucleosides.

Embodiment 13

The oligomeric compound of arty of embodiments 1-11, wherein the modified oligonucleotide consists of 17-19 or 21-30 linked nucleosides.

Embodiment 14

The oligomeric compound of any of embodiments 1-13, wherein the modified oligonucleotide consists of 16, 17, 18, 19, or 20 linked nucleosides.

Embodiment 15

The oligomeric compound of embodiment 14, wherein the modified oligonucleotide consists of 20 linked nucleosides.

Embodiment 16

The oligomeric compound of embodiment 14, wherein the modified oligonucleotide consists of 18 linked nucleosides.

Embodiment 17

The oligomeric compound of any of embodiments 1-16, wherein the modified oligonucleotide comprises at least one modified nucleoside comprising a modified sugar moiety.

Embodiment 18

The oligomeric compound of embodiment 17, wherein the modified oligonucleotide comprises at least one modified nucleoside comprising a bicycle sugar moiety.

Embodiment 19

The oligomeric compound of embodiment 18, wherein the bicyclic sugar moiety comprises a 4'-2' bridge, wherein the 4'-2' bridge is selected from —CH$_2$—O—; and —CH(CH$_3$)—O—.

Embodiment 20

The oligomeric compound of any of embodiments 17-19, wherein the modified oligonucleotide does not comprise more than six bicyclic sugar moieties.

Embodiment 21

The oligomeric compound of embodiment 17, wherein the modified oligonucleotide does not comprise a bicyclic sugar moiety.

Embodiment 22

The oligomeric compound of any of embodiments 17-20, wherein the modified oligonucleotide does not comprise more than six LNA sugar moieties.

Embodiment 23

The oligomeric compound of any of embodiments 17-21, wherein the modified oligonucleotide does not comprise a LNA sugar moiety.

Embodiment 24

The oligomeric compound of any of embodiments 17-23, wherein the modified oligonucleotide comprises at least one modified nucleoside comprising a non-bicyclic modified sugar moiety.

Embodiment 25

The oligomeric compound of embodiment 24, wherein the non-bicyclic modified sugar moiety is a 2'-MOE sugar moiety or a 2'-OMe sugar moiety.

Embodiment 26

The oligomeric compound of any of embodiments 17-25, wherein the modified oligonucleotide comprises at least one modified nucleoside comprising a sugar surrogate.

Embodiment 27

The oligomeric compound of embodiment 26, wherein the sugar surrogate is any of morpholino, modified morpholino, PNA, MP, and F-HNA.

Embodiment 28

The oligomeric compound of any of embodiments 1-27, wherein the modified oligonucleotide is a gapmer.

Embodiment 29

The oligomeric compound of any of embodiments 1-28, wherein the modified oligonucleotide comprises:
a 5'-region consisting of 1-6 linked 5'-region nucleosides;
a central region consisting of 6-10 linked central region nucleosides; and
a 3'-region consisting of 1-6 linked 3'-region nucleosides; wherein
each of the 5'-region nucleosides and each of the 3'-region nucleosides comprises a modified sugar moiety
and at least six of the central region nucleosides comprise a 2'-β-D-deoxyribosyl sugar moiety.

Embodiment 30

The oligomeric compound of any of embodiments 1-28, wherein the modified oligonucleotide comprises:
a 5'-region consisting of 1-6 linked 5'-region nucleosides;
a central region consisting of 6-10 linked central region nucleosides; and
a 3'-region consisting of 1-6 linked 3'-region nucleosides; wherein
each of the 5'-region nucleosides and each of the 3'-region nucleosides comprises a modified sugar moiety
and each of the central region nucleosides comprises a 2'-β-D-deoxyribosyl sugar moiety.

Embodiment 31

The oligomeric compound of embodiment 29, wherein the modified oligonucleotide comprises:

a 5'-region consisting of 5 linked 5'-region nucleosides;
a central region consisting of 10 linked central region nucleosides; and
a 3'-region consisting of 5 linked 3'-region nucleosides; wherein
each of the 5'-region nucleosides and each of the 3'-region nucleosides comprises a 2'-MOE modified sugar moiety, and at least six of the central region nucleosides comprise a 2'-β-D-deoxyribosyl sugar moiety.

Embodiment 32

The oligomeric compound of embodiment 30, wherein the modified oligonucleotide comprises:
a 5'-region consisting of 5 linked 5'-region nucleosides;
a central region consisting of 10 linked central region nucleosides; and
a 3'-region consisting of 5 linked 3'-region nucleosides; wherein
each of the 5'-region nucleosides and each of the 3'-region nucleosides comprises a 2'-MOE modified sugar moiety, and each of the central region nucleosides comprises a 2'-3-D-deoxyribosyl sugar moiety.

Embodiment 33

The oligomeric compound of embodiment 29, wherein the modified oligonucleotide comprises:
a 5'-region consisting of 6 linked 5'-region nucleosides;
a central region consisting of 10 linked central region nucleosides; and
a 3'-region consisting of 4 linked 3'-region nucleosides; wherein
each of the 5'-region nucleosides and each of the 3'-region nucleosides comprises a 2'-MOE modified sugar moiety, and at least six of the central region nucleosides comprise a 2'-β-D-deoxyribosyl sugar moiety.

Embodiment 34

The oligomeric compound of embodiment 30, wherein the modified oligonucleotide comprises:
a 5'-region consisting of 6 linked 5'-region nucleosides;
a central region consisting of 10 linked central region nucleosides; and
a 3'-region consisting of 4 linked 3'-region nucleosides; wherein
each of the 5'-region nucleosides and each of the 3'-region nucleosides comprises a 2'-MOE modified sugar moiety, and each of the central region nucleosides comprises a 2'-β-D-deoxyribosyl sugar moiety.

Embodiment 35

The oligomeric compound of embodiment 29, wherein the modified oligonucleotide comprises:
a 5'-region consisting of 4 linked 5'-region nucleosides;
a central region consisting of to linked central region nucleosides; and
a 3'-region consisting of 6 linked 3'-region nucleosides; wherein
each of the 5'-region nucleosides and each of the 3'-region nucleosides comprises a 2 MOE modified sugar moiety, and at least six of the central region nucleosides comprise a 2'-β-D-deoxyribosyl sugar moiety.

Embodiment 36

The oligomeric compound of embodiment 30, wherein the modified oligonucleotide comprises:
a 5'-region consisting of 4 linked 5'-region nucleosides;
a central region consisting of 10 linked central region nucleosides; and
a 3'-region consisting of 6 linked 3'-region nucleosides; wherein
each of the 5'-region nucleosides and each of the 3'-region nucleosides comprises a 2'-MOE modified sugar moiety, and each of the central region nucleosides comprises a 2-β-D-deoxyribosyl sugar moiety.

Embodiment 37

The oligomeric compound of embodiment 29, wherein the modified oligonucleotide comprises:
a 5'-region consisting of 4 linked 5'-region nucleosides;
a central region consisting of 8 linked central region nucleosides; and
a 3'-region consisting of 6 linked 3'-region nucleosides; wherein
each of the 5'-region nucleosides and each of the 3'-region nucleosides comprises a 2'-MOE modified sugar moiety, and at least six of the central region nucleosides comprise a 2'-β-D-deoxyribosyl sugar moiety.

Embodiment 38

The oligomeric compound of embodiment 30, wherein the modified oligonucleotide comprises:
a 5'-region consisting of 4 linked 5'-region nucleosides;
a central region consisting of 8 linked central region nucleosides; and
a 3'-region consisting of 6 linked 3'-region nucleosides; wherein
each of the 5'-region nucleosides and each of the 3'-region nucleosides comprises a 2'-MOE modified sugar moiety, and each of the central region nucleosides comprises a 2'-β-D-deoxyribosyl sugar moiety.

Embodiment 39

The oligomeric compound of embodiment 29, wherein the modified oligonucleotide comprises:
a 5'-region consisting of 6 linked 5'-region nucleosides;
a central region consisting of 8 linked central region nucleosides; and
a 3'-region consisting of 4 linked 3'-region nucleosides; wherein
each of the 5'-region nucleosides and each of the 3'-region nucleosides comprises a 2'-MOE modified sugar moiety, and at least six of the central region nucleosides comprise a 2'-β-D-deoxyribosyl sugar moiety.

Embodiment 40

The oligomeric compound of embodiment 30, wherein the modified oligonucleotide comprises:
a 5'-region consisting of 6 linked 5'-region nucleosides;
a central region consisting of 8 linked central region nucleosides; and
a 3'-region consisting of 4 linked 3'-region nucleosides; wherein.
each of the 5'-region nucleosides and each of the 3'-region nucleosides comprises a 2'-MOE modified sugar moiety, and each of the central region nucleosides comprises a 2'-β-D-deoxyribosyl sugar moiety.

Embodiment 41

The oligomeric compound of embodiment 29, wherein the modified oligonucleotide comprises:

a 5'-region consisting of 5 linked 5'-region nucleosides;
a central region consisting of 8 linked central region nucleosides; and
a 3'-region consisting of 5 linked 3'-region nucleosides; wherein
each of the 5'-region nucleosides and each of the 3'-region nucleosides comprises a 2'-MOs modified sugar moiety; and at least six of the central region nucleosides comprise a 2'-β-D-deoxyribosyl sugar moiety.

Embodiment 42

The oligomeric compound of embodiment 30, wherein the modified oligonucleotide comprises:
a 5'-region consisting of 5 linked 5'-region nucleosides;
a central region consisting of 8 linked central region nucleosides; and
a 3'-region consisting of 5 linked central region nucleosides; wherein
each of the 5'-region nucleosides and each of the 3'-region nucleosides comprises a 2'-MOE modified sugar moiety, and each of the central region nucleosides comprises a 2'13-D-deoxyribosyl sugar moiety.

Embodiment 43

The oligomeric compound of embodiment 29 or embodiment 30, wherein the 5'-region or the 3'-region comprises at least one bicyclic nucleoside.

Embodiment 44

The oligomeric compound of embodiment 29 or embodiment 30, wherein the 5'-region or the 3'-region comprises at least one nucleoside that is DOE a bicyclic nucleoside.

Embodiment 45

The oligomeric compound of embodiment 29 or embodiment 30, wherein the 5'-region or the 3'-region comprises at least one nucleoside that is not a LNA nucleoside.

Embodiment 46

The oligomeric compound of any of embodiments 1-45, wherein the modified oligonucleotide comprises at least one modified internucleoside linkage.

Embodiment 47

The oligomeric compound of embodiment 46, wherein at least one modified internucleoside linkage is a phosphorothioate internucleoside linkage.

Embodiment 48

The oligomeric compound of embodiment 46 or embodiment 47, wherein each internucleoside linkage is a modified internucleoside linkage.

Embodiment 49

The oligomeric compound of embodiment 48, wherein each internucleoside linkage is a phosphorothioate internucleoside linkage.

Embodiment 50

The oligomeric compound of any of embodiments 46-47, wherein at least one internucleoside linkage of the modified oligonucleotide is a phosphodiester internucleoside linkage.

Embodiment 51

The oligomeric compound of any of embodiments 1-46, wherein each internucleoside linkage of the modified oligonucleotide is independently selected from a phosphodiester or a phosphorothioate internucleoside linkage.

Embodiment 52

The oligomeric compound of any of embodiments 1-47 or 50-51, wherein at least 10, at least 11, at least 1.2, at least 13, at least 14, at least 15, at least 16, at least 17, or at least 18 internucleoside linkages of the modified oligonucleotide are phosphorothioate internucleoside linkages.

Embodiment 53

The oligomeric compound of embodiment 46, wherein the internucleoside linkage motif of the modified oligonucleotide is selected from soooosssssssssssooss, sooooosssssssss-soss, sooosssssssssoooss, soosssssssssoooss, sooooosssssssss-soss, and sooossssssssssooss,
wherein s=a phosphorothioate internucleoside linkage and o=a phosphodiester internucleoside linkage.

Embodiment 54

The oligomeric compound of any of embodiments 1-53, wherein the modified oligonucleotide comprises at least one modified nucleobase.

Embodiment 55

The oligomeric compound of embodiment 54, wherein the modified nucleobase is a 5-methyl cytosine.

Embodiment 56

The oligomeric compound of any of embodiments 1-55, wherein the oligomeric compound is capable of reducing the amount of SCN2A RNA in vitro by at least 50%, at least 60%, at least 70%, at least 80%, or at least 90% when administered according to a standard in vitro assay.

Embodiment 57

An oligomeric compound comprising a modified oligonucleotide according to the following chemical notation: $G_{es}{}^mC_{eo}A_{eo}T_{eo}A_{eo}A_{ds}T_{ds}{}^mC_{ds}{}^mC_{ds}{}^mC_{ds}A_{ds}T_{ds}T_{ds}A_{ds}T_{ds}A_{eo}{}^mC_{eo}A_{es}A_{es}A_{e}$(SEQ ID NO: 2493), wherein:
A=an adenine nucleobase.
$^mC$=a 5-methyl cytosine nucleobase,
G=a guanine nucleobase,
T=a thymine nucleobase,
e=a 2'-MOE sugar moiety,
d=a 2'-β-D-deoxyribosyl sugar moiety.
s=a phosphorothioate internucleoside linkage, and
o=a phosphodiester internucleoside linkage.

Embodiment 58

An oligomeric compound comprising a modified oligonucleotide according to the following chemical notation:

$^{m}C_{es}{}^{m}C_{eo}A_{eo}{}^{m}C_{ec}G_{eo}A_{eo}{}^{m}C_{ds}A_{ds}T_{ds}A_{ds}T_{ds}T_{ds}T_{ds}T_{ds}$ $T_{ds}{}^{m}C_{ds}T_{eo}A_{es}{}^{m}C_{es}A_e$ (SEQ ID NO: 2514), wherein:
- A=an adenine nucleobase,
- $^{m}$C=a 5-methyl cytosine nucleobase,
- G=a guanine nucleobase,
- T=a thymine nucleobase,
- e=a 2'-MOE sugar moiety.
- d=a 2'-β-D-deoxyribosyl sugar moiety,
- s=a phosphorothioate internucleoside linkage, and
- o=a phosphodiester internucleoside linkage.

Embodiment 59

An oligomeric compound comprising a modified oligonucleotide according to the following chemical notation: $^{m}C_{es}{}^{m}C_{eo}A_{eo}{}^{m}C_{eo}G_{eo}A_{eo}{}^{m}C_{ds}A_{ds}T_{ds}A_{ds}T_{ds}T_{ds}T_{ds}T_{ds}$ $T_{ds}{}^{m}C_{ds}T_{eo}A_{es}{}^{m}C_{es}A_e$ (SEQ ID NO: 2510), wherein:
- A=an adenine nucleobase,
- $^{m}$C=a 5-methyl cytosine nucleobase,
- G=a guanine nucleobase,
- T=a thymine nucleobase,
- e=a 2'-MOE sugar moiety.
- d=a 2'-β-D-deoxyribosyl sugar moiety,
- s=a phosphorothioate internucleoside linkage, and
- o=a phosphodiester internucleoside linkage.

Embodiment 60

An oligomeric compound comprising a modified oligonucleotide according to the following chemical notation: $T_{es}{}^{m}C_{eo}T_{eo}G_{eo}{}^{m}C_{eo}A_{eo}T_{ds}G_{ds}T_{ds}A_{ds}A_{ds}{}^{m}C_{ds}{}^{m}C_{ds}T_{ds}T_{ds}$ $T_{ds}A_{eo}T_{es}A_{es}{}^{m}C_e$ (SEQ ID NO: 2487), wherein:
- A=an adenine nucleobase,
- $^{m}$C=a 5-methyl cytosine nucleobase,
- G=a guanine nucleobase,
- T=a thymine nucleobase,
- e=a 2'-MOE sugar moiety.
- d=a 2'-β-D-deoxyribosyl sugar moiety,
- s=a phosphorothioate internucleoside linkage, and
- o=a phosphodiester internucleoside linkage.

Embodiment 61

An oligomeric compound comprising a modified oligonucleotide according to the following chemical notation: $G_{es}{}^{m}C_{eo}A_{eo}T_{eo}A_{eo}A_{ds}T_{ds}{}^{m}C_{ds}{}^{m}C_{ds}{}^{m}C_{ds}A_{ds}T_{ds}T_{ds}A_{ds}T_{ds}$ $A_{eo}{}^{m}C_{eo}A_{es}A_{es}A_e$ (SEQ ID NO: 2493), wherein:
- A=an adenine nucleobase,
- $^{m}$C=a 5-methyl cytosine nucleobase,
- G=a guanine nucleobase,
- T=a thymine nucleobase,
- e=a 2'-MOE sugar moiety.
- d=a 2'-β-D-deoxyribosyl sugar moiety,
- s=a phosphorothioate internucleoside linkage, and
- o=a phosphodiester internucleoside linkage.

Embodiment 62

An oligomeric compound comprising a modified oligonucleotide according to the following chemical notation: $G_{es}{}^{m}C_{es}T_{eo}G_{eo}{}^{m}C_{eo}A_{es}T_{ds}G_{ds}T_{ds}A_{ds}T_{ds}{}^{m}C_{ds}{}^{m}C_{ds}T_{ds}T_{eo}$ $T_{eo}A_{eo}T_{es}A_e$ (SEQ ID NO: 2534), wherein:
- A=an adenine nucleobase,
- $^{m}$C=a 5-methyl cytosine nucleobase,
- G=a guanine nucleobase,
- T=a thymine nucleobase,
- e=a 2'-MOE sugar moiety.
- d=a 2'-β-D-deoxyribosyl sugar moiety,
- s=a phosphorothioate internucleoside linkage, and
- o=a phosphodiester internucleoside linkage.

Embodiment 63

The oligomeric compound of any of embodiments 1-62 wherein the oligomeric compound is a singled-stranded oligomeric compound.

Embodiment 64

The oligomeric compound of any of embodiments 1-63, wherein the modified oligonucleotide of the oligomeric compound is a salt, and wherein the salt is a sodium salt or a potassium salt.

Embodiment 65

The oligomeric compound of any of embodiments 1-64, consisting of the modified oligonucleotide.

Embodiment 66

The oligomeric compound of any of embodiments 1-62, wherein the modified oligonucleotide is an RNAi compound.

Embodiment 67

The oligomeric compound of any of embodiments 1-66, further comprising a conjugate group.

Embodiment 68

The oligomeric compound of embodiment 67, wherein the conjugate group comprises a conjugate moiety and a conjugate linker.

Embodiment 69

The oligomeric compound of embodiment 68, wherein the conjugate group comprises a GalNAc cluster comprising 1-3 GalNAc ligands.

Embodiment 70

The oligomeric compound of embodiment 68, wherein the conjugate linker consists of a single bond.

Embodiment 71

The oligomeric compound of embodiment 68, wherein the conjugate linker is cleavable.

Embodiment 72

The oligomeric compound of embodiment 68, wherein the conjugate linker comprises 1-3 tinker-nucleosides.

Embodiment 73

The oligomeric compound of any of embodiments 67-72, wherein the conjugate group is attached to the modified oligonucleotide at the 5'-end of the modified oligonucleotide.

Embodiment 74

The oligomeric compound of any of embodiments 67-72, wherein the conjugate group is attached to the modified oligonucleotide at the 3'-end of the modified oligonucleotide.

Embodiment 75

The oligomeric compound of any of embodiments 1-74 further comprising a terminal group.

Embodiment 76

The oligomeric compound of any of embodiments 1-71 or 73.75, wherein the oligomeric compound does not comprise linker-nucleosides.

Embodiment 77

A modified oligonucleotide according to the following chemical structure:

(SEQ ID NO: 2493)

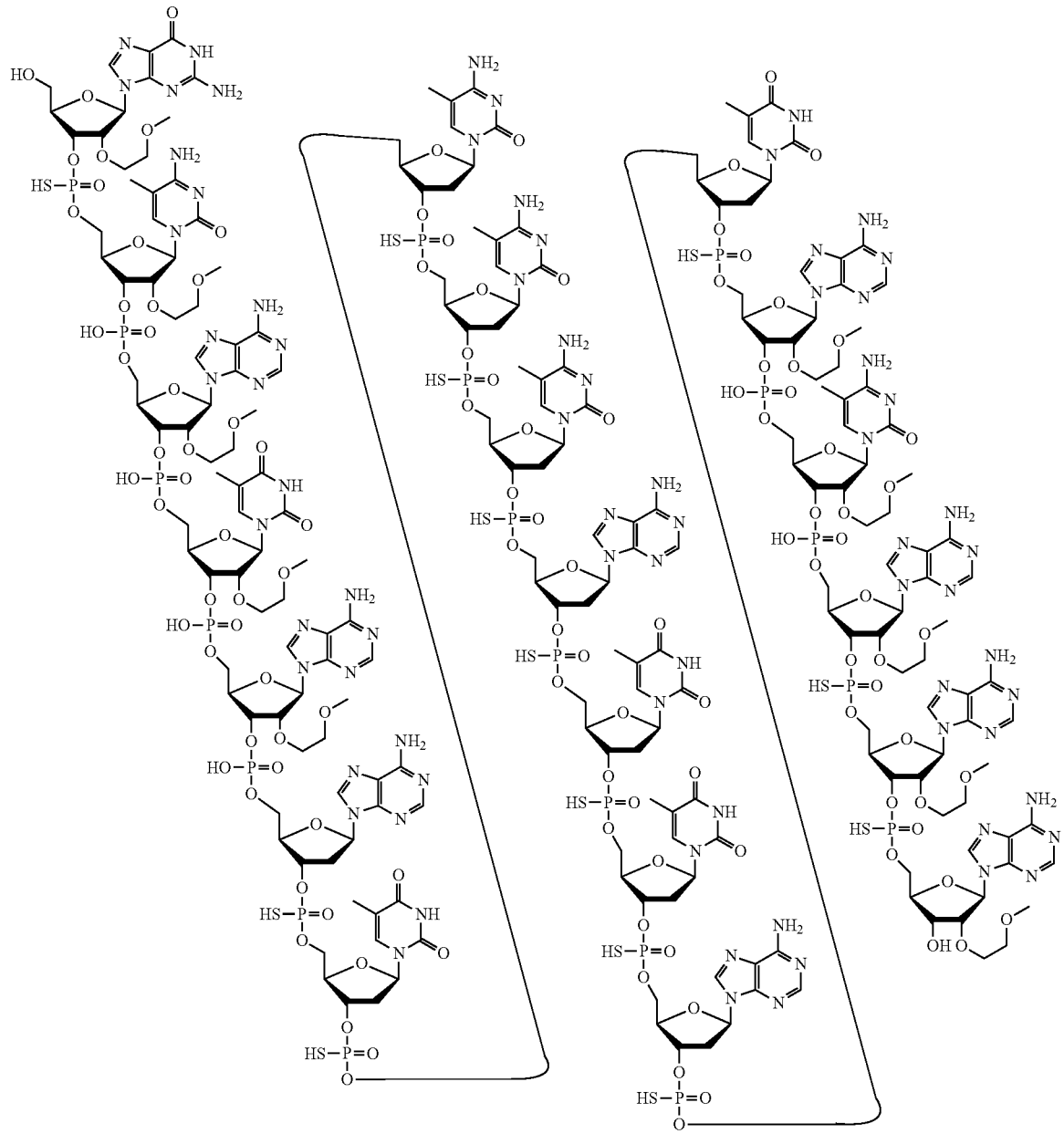

or a salt thereof.

23
Embodiment 78
A modified oligonucleotide of embodiment 77, which is the sodium salt or the potassium salt.
24
Embodiment 79
A modified oligonucleotide according to the following chemical structure:
(SEQ ID NO: 2493)
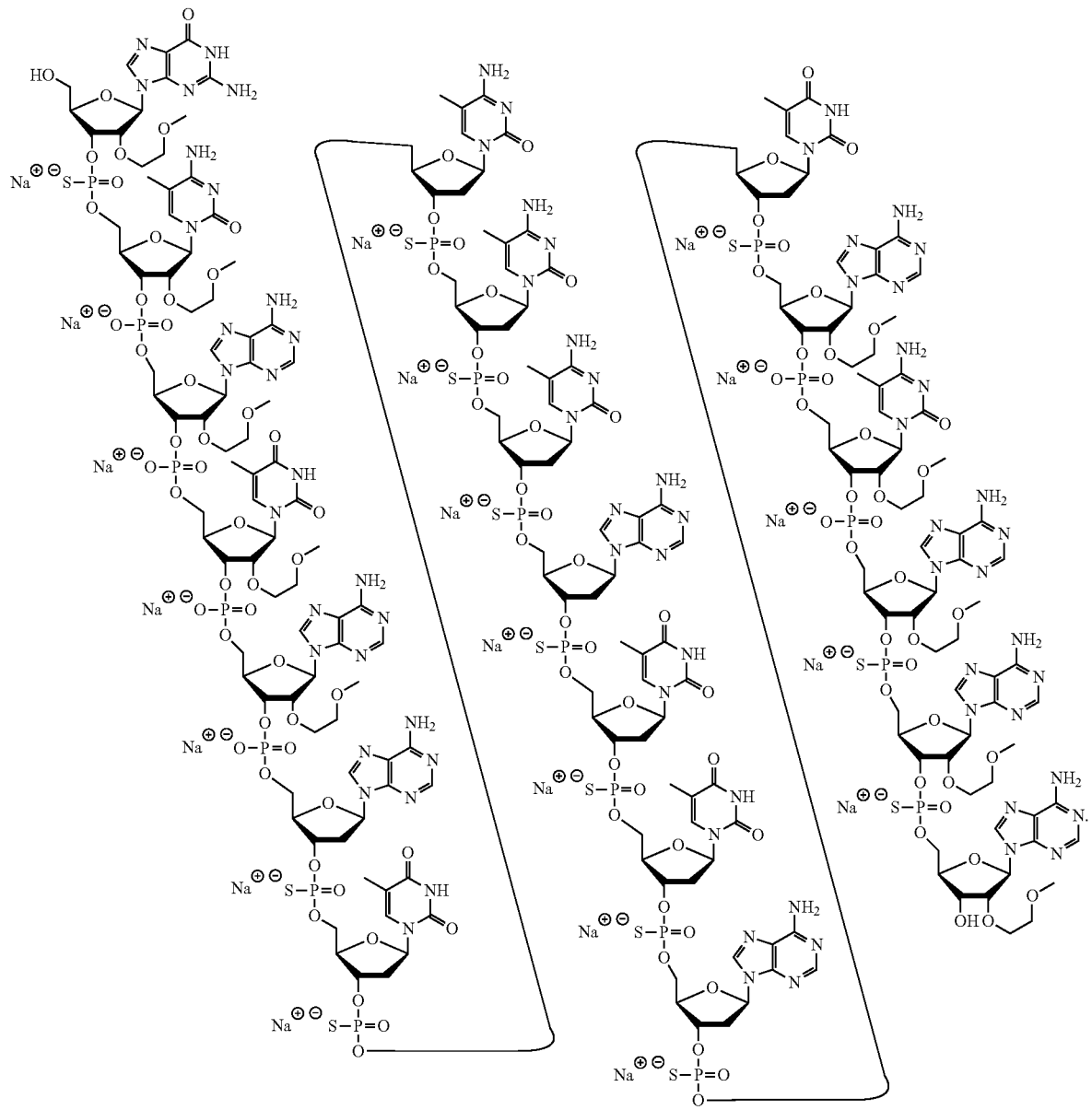
Embodiment 80
A modified oligonucleotide according to the following chemical structure:

(SEQ ID NO: 2514)
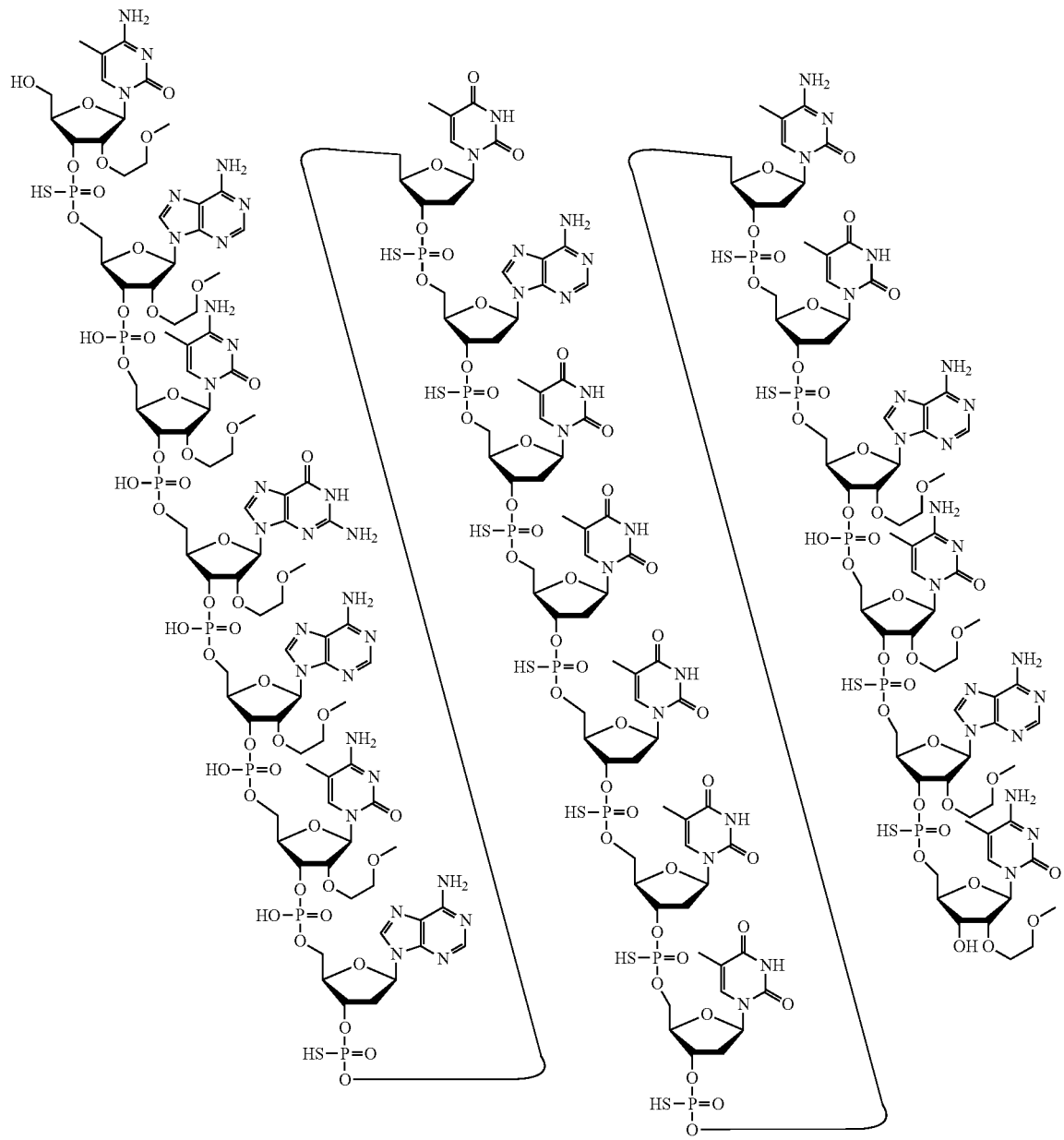
or a salt thereof.
Embodiment 81
A modified oligonucleotide of embodiment 80, which is the sodium salt or the potassium salt.
Embodiment 82
A modified oligonucleotide according to the following chemical structure:

(SEQ ID NO: 2514)
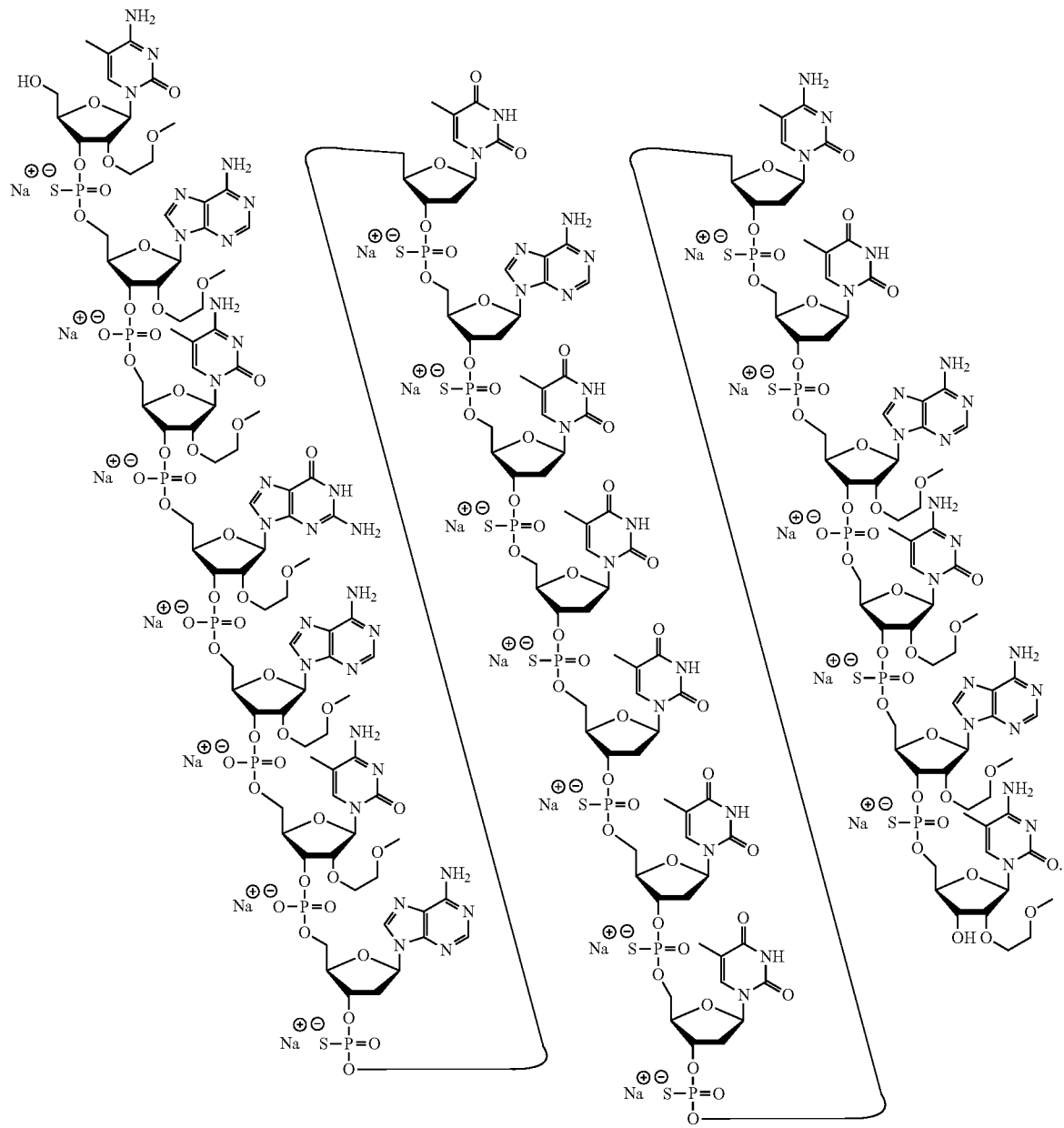
Embodiment 83
A modified oligonucleotide according to the following chemical structure:

(SEQ ID NO: 2510)
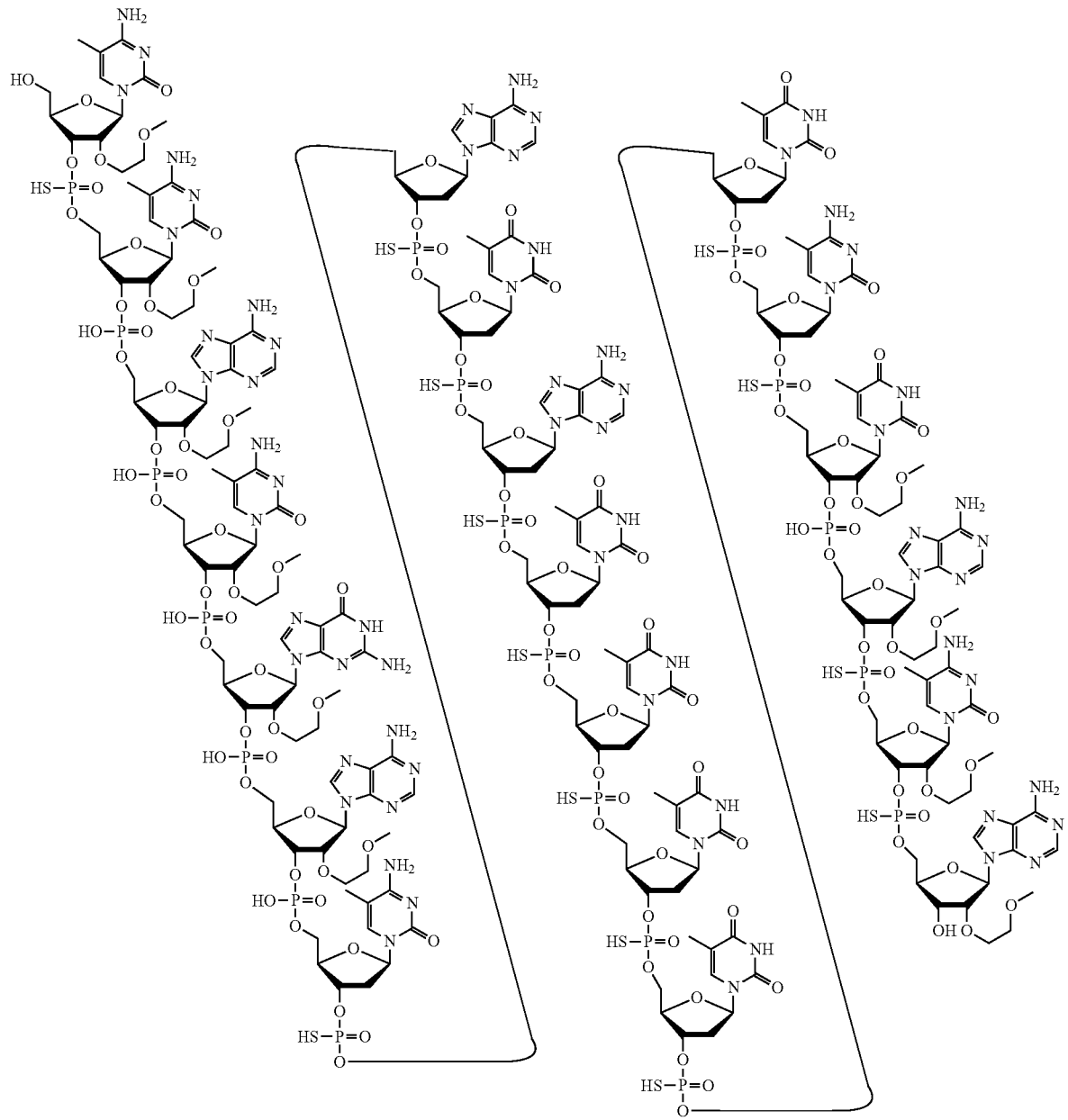
or a salt thereof.
Embodiment 84
The modified oligonucleotide of embodiment 83, which is the sodium salt or the potassium salt.
Embodiment 85
A modified oligonucleotide according to the following chemical structure:

(SEQ ID NO: 2510)
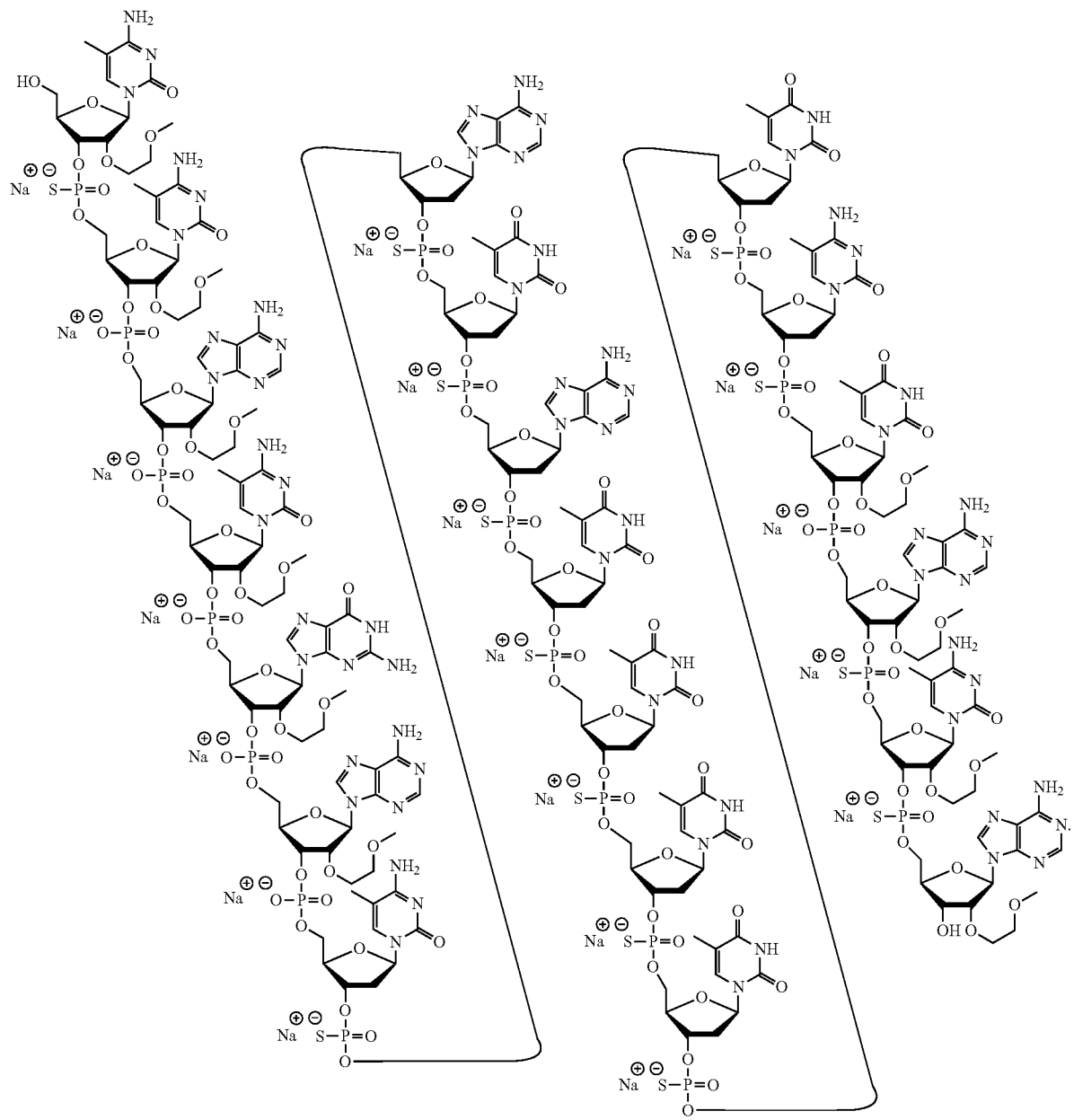
Embodiment 86
65. A modified oligonucleotide according to the following chemical structure:

(SEQ ID NO: 2487)
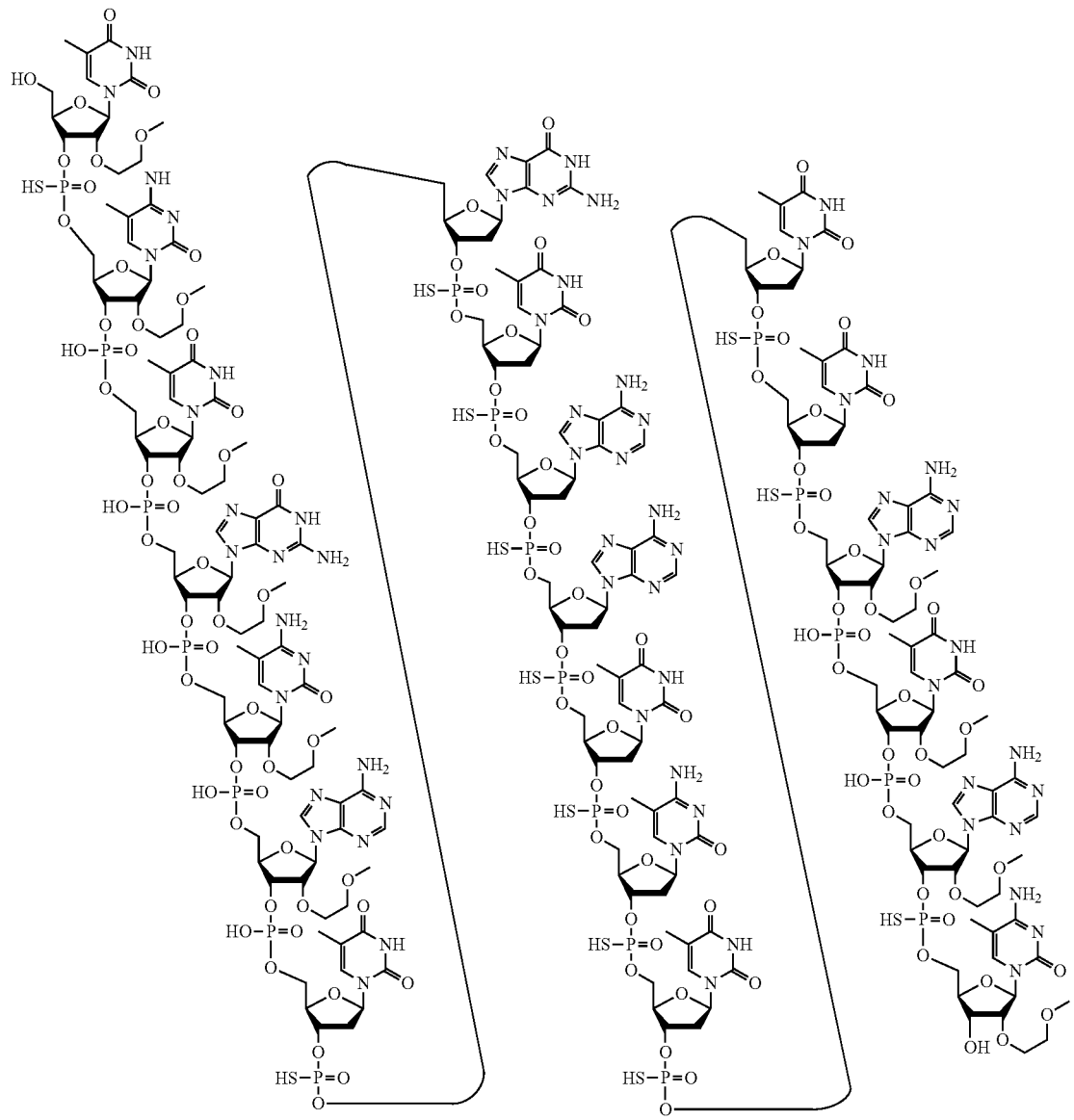
or a salt thereof.
Embodiment 87
The modified oligonucleotide of embodiment 86, which is the sodium salt or the potassium salt.
Embodiment 88
A modified oligonucleotide according to the following chemical structure:

(SEQ ID NO: 2487)
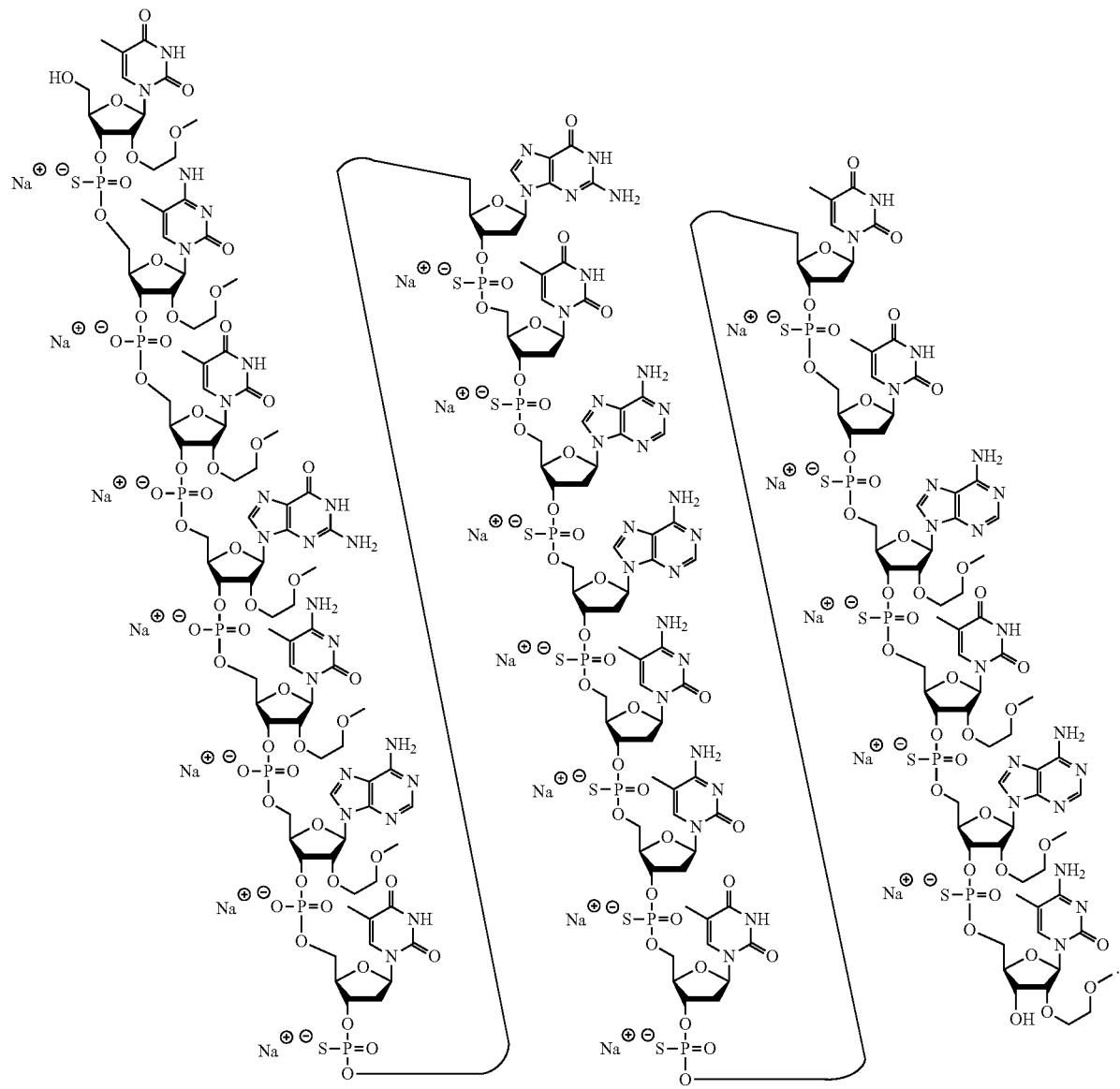
Embodiment 89
A modified oligonucleotide according to the following chemical structure:

(SEQ ID NO: 2493)
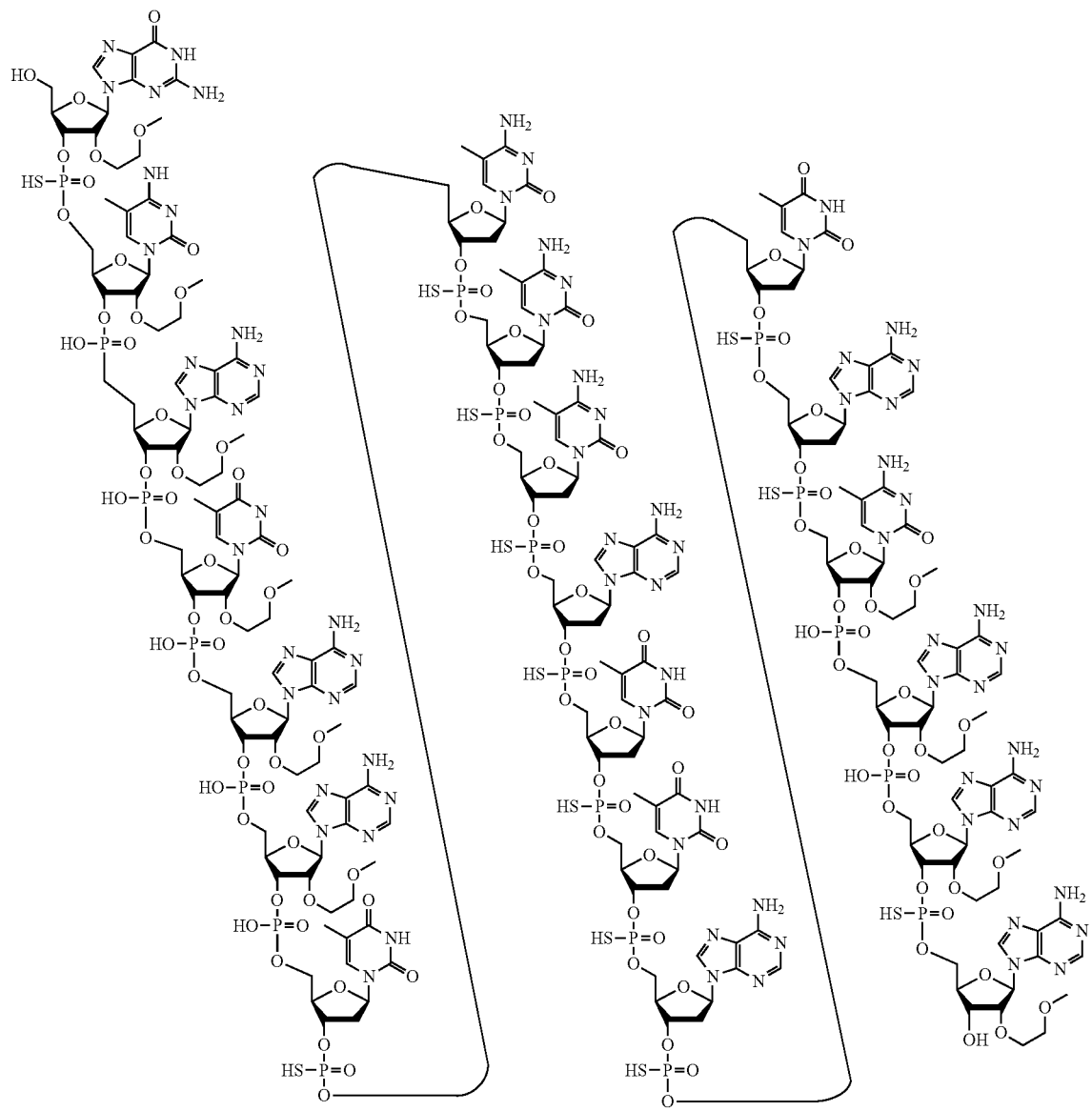
or a salt thereof.
Embodiment 90
The modified oligonucleotide of embodiment 89, which is the sodium salt or the potassium sail.
Embodiment 91
A modified oligonucleotide according to the following chemical structure:

(SEQ ID NO: 2493)
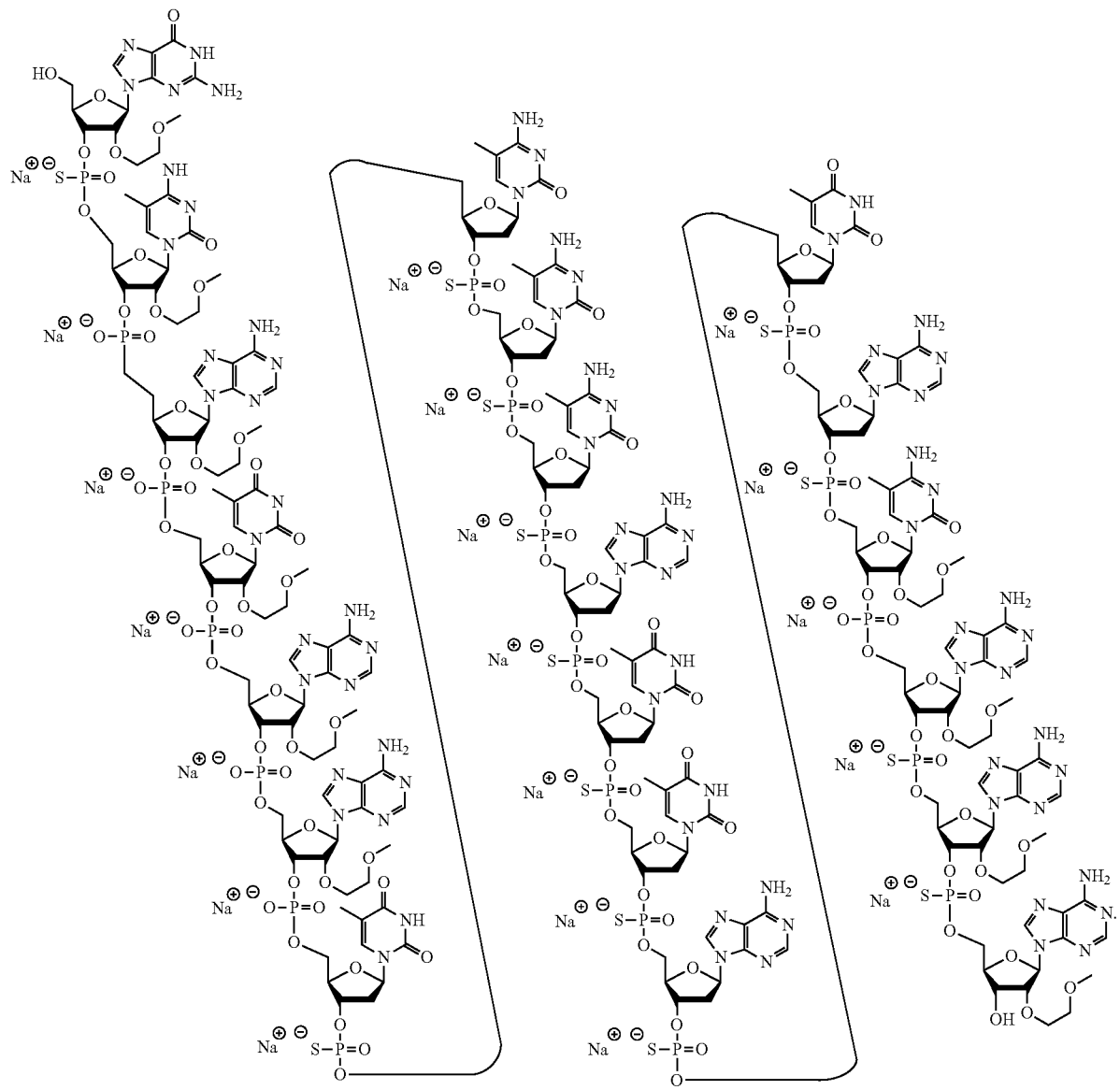
Embodiment 92
A modified oligonucleotide according to the following chemical structure:

(SEQ ID NO: 2534)
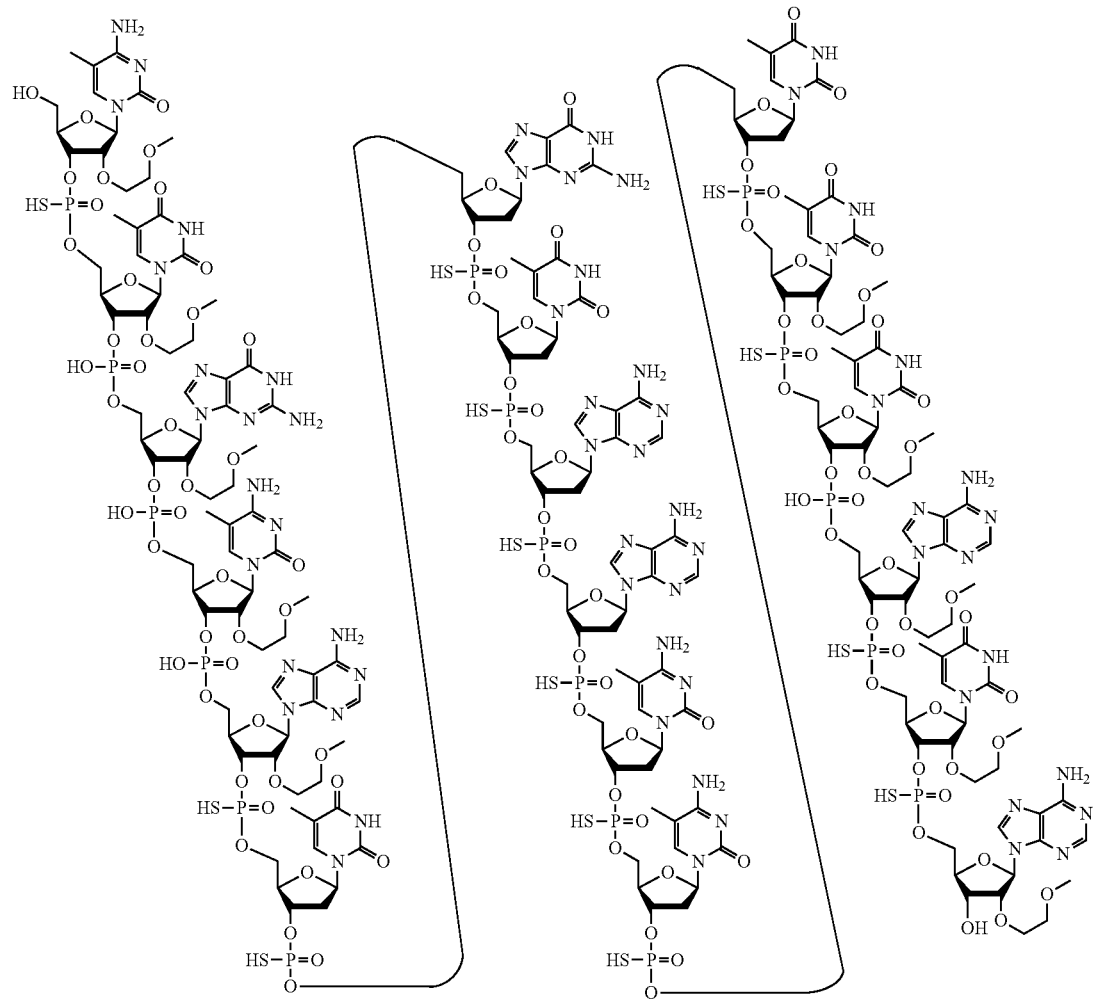
or a salt thereof.
Embodiment 93
The modified oligonucleotide of embodiment 92, which is the sodium salt or the potassium salt
Embodiment 94
A modified oligonucleotide according to the following chemical structure (SEQ ID NO: 2534)

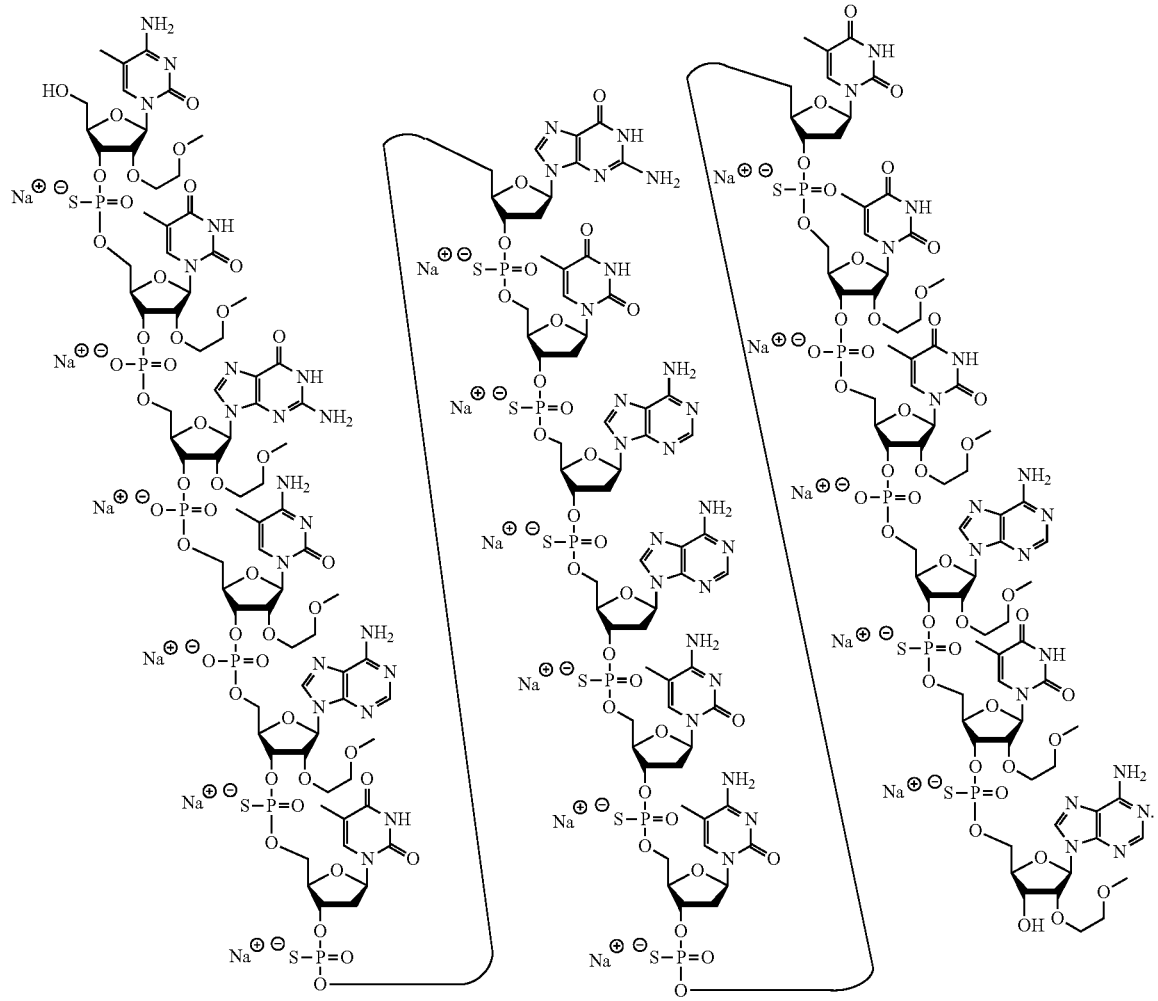

Embodiment 95

A chirally enriched population of oligomeric compounds of any of embodiments 1-76 or modified oligonucleotides of any of embodiments 77-94, wherein the population is enriched for modified oligonucleotides comprising at least one particular phosphorothioate internucleoside linkage having a particular stereochemical configuration

Embodiment 96

The chirally enriched population of embodiment 95, wherein the population is enriched for modified, oligonucleotides comprising at least one particular phosphorothioate internucleoside linkage having the (Sp) configuration.

Embodiment 97

The chirally enriched population of embodiment 95, wherein the population is enriched for modified, oligonucleotides comprising at least one particular phosphorothioate internucleoside linkage having the (Rp) configuration.

Embodiment 98

The chirally enriched population of embodiment 95, wherein the population is enriched for modified, oligonucleotides having a particular, independently selected stereochemical configuration at each phosphorothioate internucleoside linkage.

Embodiment 99

The chirally enriched population of embodiment 98, wherein the population is enriched for modified oligonucleotides having the (Sp) configuration at each phosphorothioate internucleoside linkage or for modified oligonucleotides having the (Rp) configuration at each phosphorothioate internucleoside linkage.

Embodiment 100

The chirally enriched population of embodiment 98, wherein the population is enriched for modified oligonucleotides having the (Rp) configuration at one particular phosphorothioate internucleoside linkage and the (Sp) configuration at each of the remaining phosphorothioate internucleoside linkages.

Embodiment 101

The chirally enriched population of embodiment 98, wherein the population is enriched for modified oligonucleotides having at least 3 contiguous phosphorothioate internucleoside linkages in the Sp, Sp, and Rp configurations, in the 5' to 3' direction.

Embodiment 102

A population of oligomeric compounds of any of embodiments 1-76 or modified oligonucleotides of any of embodiments 77-94, wherein all of the phosphonothioate internucleoside linkages of the modified oligonucleotide a stereorandom.

Embodiment 103

An oligomeric duplex, comprising a first oligomeric compound and a second oligomeric compound comprising a second modified oligonucleotide, wherein the first oligomeric compound is an oligomeric compound of any of embodiments 1-76.

Embodiment 104

The oligomeric duplex of embodiment 103, wherein the second oligomeric compound comprises a second modified oligonucleotide consisting of 8 to 80 linked nucleosides, and wherein the nucleobase sequence of the second modified oligonucleotide comprises a complementary region of at least 8 nucleobases that is at least 90% complementary to an equal length portion of the first modified oligonucleotide.

Embodiment 105

An antisense agent comprising an antisense compound. Wherein the antisense compound is an oligomeric compound of any of embodiments 1-76 or a modified oligonucleotide of any of embodiments 77-94.

Embodiment 106

The antisense agent of embodiment 103, wherein the antisense agent is an oligomeric duplex of embodiment 103 or embodiment 104.

Embodiment 107

The antisense agent of embodiment 105 or embodiment 106, wherein the antisense agent is:
i. an RNase H agent capable of reducing the amount of SCN2A nucleic acid through the activation of RNase H; or
ii. an RNAi agent capable of reducing the amount of SCN2A nucleic acid through the activation of RISC/Ago2.

Embodiment 108

A pharmaceutical composition comprising an oligomeric compound of any of embodiments 1-76, a modified oligonucleotide of any of embodiments 77-94, a population of any of embodiments 95-102, an oligomeric duplex of embodiment 103 or embodiment 104, or an antisense agent of any of embodiments 105-107, and a pharmaceutically acceptable diluent or carrier.

Embodiment 109

The pharmaceutical composition of embodiment 108, comprising a pharmaceutically acceptable diluent and wherein the pharmaceutically acceptable diluent is artificial CSF (aCSF) or phosphate-buffered saline (PBS).

Embodiment 110

The pharmaceutical composition of embodiment 109, wherein the pharmaceutical composition consists essentially of the oligomeric compound, the modified oligonucleotide, the population, the oligomeric duplex, or the antisense agent, and aCSF.

Embodiment 111

The pharmaceutical composition of embodiment 109, wherein the pharmaceutical composition consists essentially of the oligomeric compound, the modified oligonucleotide, the population, the oligomeric duplex, or the antisense agent, and PBS.

Embodiment 112

A pharmaceutical composition comprising a modified oligonucleotide of any of embodiments 77-94 and a pharmaceutically acceptable diluent.

Embodiment 113

The pharmaceutical composition of embodiment 112, wherein the pharmaceutically acceptable diluent is artificial cerebrospinal fluid (aCSF) or phosphate-buffered saline (PBS).

Embodiment 114

The pharmaceutical composition of embodiment 113, wherein the pharmaceutical composition consists essentially of the modified oligonucleotide and aCSF.

Embodiment 115

The pharmaceutical composition of embodiment 113, wherein the pharmaceutical composition consists essentially of the modified oligonucleotide and PBS.

Embodiment 116

A method comprising administering to a subject an oligomeric compound of any of embodiments 1-76, a modified oligonucleotide of any of embodiments 77-94, a population of any of embodiments 95-102, an oligomeric duplex of embodiment 103 or embodiment 104, an antisense agent of any of embodiments 105-107, or a pharmaceutical composition of any of embodiments 108-115.

Embodiment 117

A method of treating a disease or disorder associated with a voltage-gated sodium channel protein, comprising administering to a subject having or at risk for developing the disease or disorder associated with a voltage-gated sodium channel protein a therapeutically effective amount of an oligomeric compound of any of embodiments 1-76, a modified oligonucleotide of any of embodiments 77-94, a population of any of embodiments 95-102, an oligomeric duplex of embodiment 103 or embodiment 104, an antisense agent of any of embodiments 105-107, or a pharmaceutical composition of any of embodiments 108-115, thereby treating the disease or disorder associated with a voltage-gated sodium channel protein.

Embodiment 118

A method of reducing the amount of SCN2A protein in the CSF of a subject having or at risk for developing a disease or disorder associated with a voltage-gated sodium channel protein a therapeutically effective amount of an oligomeric compound of any of embodiments 1-76, a modified oligonucleotide of any of embodiments 77-94, a population of any of embodiments 95-102, an oligomeric duplex of embodiment 103 or embodiment 104, an antisense agent of any of embodiments 105-107, or a pharmaceutical composition of any of embodiments 108-115, thereby reducing the amount of SCN2A protein in the CSF.

Embodiment 119

The method of embodiment 117 or embodiment 118, wherein the disease or disorder is a neurodevelopmental disease.

Embodiment 120

The method of embodiment 117 or embodiment 118, wherein the disease or disorder is associated with SCN1A or SCN2A.

Embodiment 121

A method of treating a disease or disorder associated with SCN2A, comprising administering to an subject having or at risk for developing a disease or disorder associated with SCN2A a therapeutically effective amount of an oligomeric compound of am of embodiments 1-76, a modified oligonucleotide of any of embodiments 77-94, a population of any of embodiments 95-102, an oligomeric duplex of embodiment 103 or embodiment 104, an antisense agent of any of embodiments 105-107, or a pharmaceutical composition of any of embodiments 108-115, thereby treating the disease or disorder associated with SCN2A.

Embodiment 122

The method of embodiment 121, wherein the disease or disorder associated with SCN2A is a Developmental and Epileptic Encephalopathy, an intellectual disability, or an autism spectrum disorder.

Embodiment 123

The method of embodiment 122, wherein the Developmental and Epileptic Encephalopathy is any of Early Seizure Onset Epileptic Encephalopathy (EE), Late Seizure Onset Epileptic Encephalopathy, or Benign Familial Neonatal-Infantile Seizures.

Embodiment 124

The method of embodiment 121, wherein the disease or disorder associated with SCN2A is any of Ohtahara Syndrome, epilepsy with migrating focal seizures of infancy, West Syndrome, Lennon-Gastaut Syndrome; Dravet Syndrome; Idiopathic/Generic Generalized Epilepsies, Temporal Lobe Epilepsy, Myoclonic Asiatic Epilepsy, Migrating Partial Epilepsy of Infancy, or familial hemiplegic migraines.

Embodiment 125

The method of any of embodiments 118-1.20, wherein the disease or disorder is associated with SCN1A.

Embodiment 126

The method of embodiment 125, wherein the disease or disorder associated with SCN1A is a Developmental and Epileptic Encephalopathy.

Embodiment 127

The method of embodiment 125 or embodiment 126, wherein the Developmental and Epileptic Encephalopathy is Dravet Syndrome.

Embodiment 128

The method of embodiment 126 or embodiment 127, wherein the Developmental and Epileptic Encephalopathy is any of Ohtahara Syndrome, epilepsy with migrating focal seizures of infancy, West Syndrome, Lennon-Gastaut Syndrome; Dravet Syndrome; Idiopathic/Generic Generalized Epilepsies, Temporal Lobe Epilepsy, Myoclonic Asiatic Epilepsy, Migrating Partial Epilepsy of Infancy, or familial hemiplegic migraines.

Embodiment 129

The method of any of embodiments 117-128, wherein at least one symptom or hallmark of the disease or disorder is ameliorated.

Embodiment 130

The method of embodiment 129, wherein the symptom or hallmark is seizures.

Embodiment 131

The method of any of embodiment 130, wherein the seizures are any of focal, clonic, tonic, generalized tonic and clonic, convulsive, myoclonic, absence, or obtundation status.

Embodiment 132

The method of embodiment 130, wherein the seizures are any of focal, clonic, tonic, or generalized tonic.

Embodiment 133

The method of embodiment 129, wherein the symptom or hallmark is any of seizures, hypotonia, sensory integration disorders, motor dysfunctions, intellectual and cognitive dysfunctions, movement and balance dysfunctions, visual dysfunctions, delayed language and speech, gastrointestinal disorders, neurodevelopmental delays, or sudden unexpected death in epilepsy.

Embodiment 134

The method of embodiment 129, wherein the symptom or hallmark is any of motor development delays, delayed social

Embodiment 135

The method of any of embodiments 130-134, wherein the seizures are frequent or prolonged.

Embodiment 136

The method of any of embodiments 116-135 wherein administering the modified oligonucleotide reduces seizures, sensory integration disorders, motor dysfunctions, intellectual and cognitive dysfunctions, movement and balance dysfunctions, visual dysfunctions, delayed language and speech, gastrointestinal disorders, neurodevelopmental delays, motor development delays, delayed social milestones, repetitive actions, uncoordinated oral movements, or sleep problems, or delays death in the subject.

Embodiment 137

The method of any of embodiments 116-136, wherein the oligomeric compound, the modified oligonucleotide, the population, the oligomeric duplex, the antisense agent, or the pharmaceutical composition is administered to the central nervous system or systemically.

Embodiment 138

The method of any of embodiments 116-136, wherein the oligomeric compound, the modified oligonucleotide, the population, the oligomeric duplex, the antisense agent, or the pharmaceutical composition is administered to the central nervous system and systemically.

Embodiment 139

The method of any of embodiments 111-131, wherein the oligomeric compound, the modified oligonucleotide, the population, the oligomeric duplex, the antisense agent, or the pharmaceutical composition is administered by any of intrathecally, systemically, subcutaneously, or intramuscularly.

Embodiment 140

The method of any of embodiments 116-1.39, wherein the subject is human.

Embodiment 141

A method of reducing the amount of SCN2A RNA in a cell comprising contacting the cell with an oligomeric compound of any of embodiments 1-76, a modified oligonucleotide of any of embodiments 77-94, a population of any of embodiments 95-102, an oligomeric duplex of embodiment 103 or embodiment 104, an antisense agent of any of embodiments 105-107, or a pharmaceutical composition of any of embodiments 108-115, thereby reducing the amount of SCN2A RNA in the cell.

Embodiment 142

A method of reducing the amount of SCN2A protein in a cell comprising contacting the cell with an oligomeric compound of any of embodiments 1-76, a modified oligonucleotide of any of embodiments 77-94, a population of any of embodiments 95-102, an oligomeric duplex of embodiment 103 or embodiment 104, an antisense agent of any of embodiments 105-107, or a pharmaceutical composition of any of embodiments 108-115, thereby reducing the amount of SCN2A protein in the cell.

Embodiment 143

The method of embodiment 141 or embodiment 142, wherein the cell is a cortical cell, a hippocampal cell, or a spinal cord cell.

Embodiment 144

The method of any of embodiments 141-143, wherein the cell is in an animal.

Embodiment 145

The method of any of embodiments 141-144, wherein the cell is a human cell.

Embodiment 146

Use of an oligomeric compound d of any of embodiments 1-76, a modified oligonucleotide of any of embodiments 77-94, a population of any of embodiments 95-102, an oligomeric duplex of embodiment 103 or embodiment 104, an antisense agent of any of embodiments 105-107, or a pharmaceutical composition of any of embodiments 108-115 for reducing SCN2A expression in a cell.

Embodiment 147

The use of embodiment 146, wherein the level of SCN2A RNA in the cell is reduced.

Embodiment 148

The use of embodiment 0.146 or embodiment 147, wherein the level of SCN2A protein in the cell is reduced.

Embodiment 149

The use of any of embodiments 146-148, wherein the cell is a corical cell, a hippocampal cell, or a spinal cord cell.

I. Certain Oligonucleotides

In certain embodiments, provided herein are oligomeric compounds comprising oligonucleotides, which consist of linked nucleosides. Oligonucleotides may be unmodified oligonucleotides (RNA, or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Soar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2-O(CH$_2$)$_2$OCH$_3$ ("MOE" or "O-methoxyethyl"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, O-alkylenyl-O-alkyl, alkynyl, Alkaryl, aralkyl, O-alkaryl, O-aralkyl, O(CH$_2$)$_2$SCH$_2$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$alkyl, and the 2'-substituent groups described in Cook et al, U.S. Pat. No. 6,531,584; Cook et al., U.S. Pat. No. 5,859,221; and Cook et al. U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but ale not limited to: 5'-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted ion-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ ON(R$_m$)(R$_n$), O(CH$_2$)$_2$O(CH$_2$)$_2$N(CH$_3$)$_2$, and N-substituted acetamide (OCH$_2$C(=O)N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted non bicyclic modified nucleoside comprises a sugar moiety comprising a non-bridging 2'-substituent group selected from: F, OCF$_3$, OCH$_3$, OCH$_2$CH$_2$OCH$_3$, O(OH$_2$)$_2$SCH$_3$, O(CH$_2$)$_2$ON (CH$_3$)$_2$. O(CH$_2$)$_2$O(CH$_2$)$_2$N(CH$_3$)$_2$, and OCH$_2$C(=O)—N (H)CH$_3$ ("NMA").

In certain embodiments, a 2'-substituted non-bicyclic modified nucleoside comprises a sugar moiety comprising a non-bridging 2'-substituent group selected from: F, OCH$_3$, and OCH$_2$CH$_2$OCH$_3$.

In certain embodiments, modified furanosyl sugar moieties and nucleosides incorporating such modified furanosyl sugar moieties are further defined by isomeric configuration. For example, a 2'-deoxyfuranosyl sugar moiety may be in seven isomeric configurations other than the naturally occurring β-D-deoxyribosyl configuration. Such modified sugar moieties are described in. e.g., WO 2019/157531, incorporated by reference herein. A 2'-modified sugar moiety has an additional stereocenter at the 2'-position relative to a 2'-deoxyfuranosyl sugar moiety: therefore, such sugar moieties have a total of sixteen possible isomeric configurations. 2'-modified sugar moieties described herein are in the β-D-ribosyl isomeric configuration unless otherwise specified.

Certain modified sugar moieties comprise a substituent that bridges two atoms of the furanosyl ring to form a second ring, resulting in a bicyclic sugar moiety. Nucleosides comprising such bicyclic sugar moieties have been referred to as bicyclic nucleosides (BNAs), locked nucleosides, or conformationally restricted nucleotides (CRN). Certain such compounds are described in US Patent Publication No. 2013/0190383; and PCT publication. WO 2013/036868. In certain such embodiments, the bicyclic sugar moiety comprises a bridge between the 4' and the 2' furanose ring atoms. In certain such embodiments, the furanose ring is a ribose ring. Examples of such 4' to 2' bridging sugar substituents include but are not limited to: 4'-CH$_2$-2', 4—(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_2$—O-2' (referred to as "constrained ethyl" or "cEt" when in the S configuration), 4'-CH$_2$—O—CH$_2$-2', 4'-CH$_2$—N(R)-2', 4'-CH (CH$_2$OCH$_3$)—O-2' ("constrained MOE" or "cMOE") and analogs thereof (see, e.g., Seth et al., U.S. Pat. No. 7,399, 845, Bhat et al., U.S. Pat. No. 7,569,686. Swayze et al., U.S. Pat. No. 7,741,457, and Swayze et al., U.S. Pat. No. 8,022, 193), 4'-C(CH$_3$)(CH$_3$)—O-2' and analogs thereof (see. e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4-CH$_2$—O—N(CH$_3$)-2' (see, e.g., Allerson et al., U.S. Pat. No. 7,696,345 and Allerson et al., U.S. Pat. No. 8,124,745), 4-CH$_2$—C(H)(CH$_3$)-2' (see, e.g., Zhou, et al., *J. Org. Chem.*, 2009, 74, 118-134), 4'-CH$_2$—C(=CH$_2$)-2' and analogs thereof (see e.g., Seth et al., U.S. Pat. No. 8,278, 426), 4'-C(R$_a$R$_b$)—N(R)—O-2', 4'-C(R$_a$R$_b$)—O—N(R)-2', 4'-CH$_2$—O—N(R)-2', and 4-CH$_2$—N(R)—O-2, wherein each R, R$_a$, and R$_b$ is independently, H, a protecting group, or C$_1$-C$_{12}$ alkyl (see, e.g. Imanishi et al., U.S. Pat. No. 7,427,672). In certain embodiments, such 4' to 2' bridges independently comprise from 1 to 4 linked groups independently selected from: —[C(R$_a$)(R$_b$)]$_n$—, —[(C(R$_a$)(R$_b$)]$_n$—, —C(R$_a$)=C(R$_b$)—, —C(R$_a$)=N—, —C(=NR$_a$)—, —C(=O)—, —C(=S)—, —O—, —Si(R$_a$)$_2$—, —S (=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_3$J$_2$, SJ$_1$, N$_3$, COOJ$_1$, acyl (C(=O)—H), substituted acv, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryL acyl (C(=O)—H), substituted acyl, a heterocycle radical a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., Nucleic Acids Research, 1997, 25(22), 44294443, Albaek et al., J. Org. Chem., 2006, 71, 7731-7740, Singh et al., Chem. Commun., 1998, 4, 455-456; Koshkin et al., Tetrahedron, 1998, 54, 3607-3630; Wahlestedt et al., Proc. Natl. Acad. Sci. U.S.A., 2000, 97, 56133-5638; Kumar et al, Bioorg. Med. Chem. Lett., 1998, 8, 2219-2222; Singh et al., J. Org. Chem., 1998, 63, 10035-10039; Srivastava et al., J. Am. Chem. Soc., 2007, 129, 8362-8379; Elayadi et al., Curr. Opinion Inverts. Drugs, 2001, 2, 558-561; Braasch et al., Chem. Biol., 2001, 8, 1-7; Orum et al. Curr. Opinion Mol. Ther., 2001, 3, 239-243; Wengel et al., U.S. Pat. No. 7,053,207, Imanishi et al., U.S. Pat. No. 6,268,490, Imanishi et at U.S. Pat. No. 6,770,748, Imanishi et al., U.S. Pat. No. RE44,779; Wengel et al., U.S. Pat. No. 6,794,499. Wengel et al., U.S. Pat. No. 6,670,461; Wengel et al., U.S. 7,034,133, Wengel et al., U.S. Pat. No. 8,080,644; Wengel et al., U.S. Pat. No. 8,034,909, Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181: Seth et al., U.S. Pat. No. 7,547,684; Seth et al., U.S. Pat. No. 7,666,854; Seth et al. U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805, Allerson et al., US2008/0039618; and Migawa et al., US2015/0191727.

In certain embodiments, bicyclic sugar moieties and nucleosides incorporating such bicyclic sugar moieties are thither defined by isomeric configuration. For example, an LNA nucleoside (described herein) may be in the α-L configuration or in the β-D configuration.

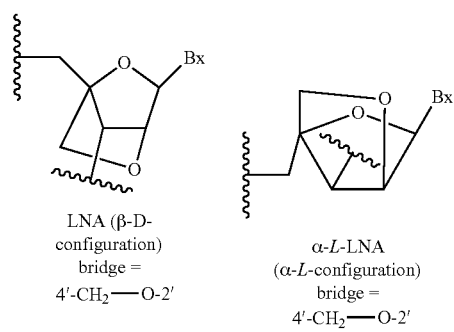

LNA (β-D-configuration) bridge = 4'-$CH_2$—O-2'

α-L-LNA (α-L-configuration) bridge = 4'-$CH_2$—O-2'

α-L-methyleneoxy 4'-$CH_2$—O-2') or α-L-LNA bicyclic nucleosides have been incorporated into oligonucleotides that showed antisense activity (Frieden et al., *Nucleic. Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the J-D configure Eon, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("NINA") (see, e.g., Leumann, C J. *Bioorg. & Med. Chem.* 2002, 10, 841-854), fluoro HNA:

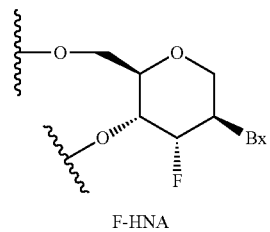

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

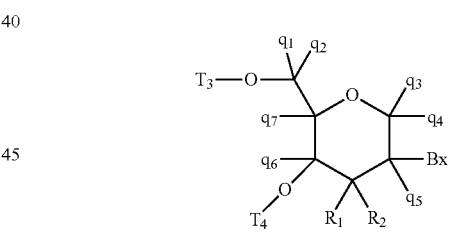

wherein, independently, for each of the modified THP nucleosides:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $g_6$ and $q_7$ are each, independently, H, $C_1$-$C_6$ alkyl, substituted $C_1$-$C_6$ alkyl, $C_1$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, OC(=X)$J_1$, OC(=X)$NJ_1J_2$, $NJ_3$C (=X)NJ$_1$J$_2$, and CN, wherein X is O, S or NJ$_1$, and each J$_1$, J$_2$, and J$_3$ is, independently, H or C$_1$-C$_6$ alkyl.

In certain embodiments, modified THP nucleosides are provided wherein q$_1$, q$_2$, q$_3$, q$_4$, q$_5$, q$_6$ and q$_7$ are each H. In certain embodiments, at least one of q$_1$, q$_2$, q$_3$, q$_4$, q$_5$, q$_6$ and q$_7$ is other than H. In certain embodiments, at least one of q$_1$, q$_2$, q$_3$, q$_4$, q$_5$, g$_6$ and q$_7$ is methyl. In certain embodiments, modified THP nucleosides are provided wherein one of and R$_2$ is F. In certain embodiments, R$_1$ is F and R$_2$ is H, in certain embodiments, R$_1$ is methoxy and R$_2$ is H, and in certain embodiments, R$_1$ is methoxyethoxy and R$_2$ is H.

In certain embodiments, sugar surrogates comprise rings having more than 5 atoms and more than one heteroatom. For example, nucleosides comprising morpholino sugar moieties and their use in oligonucleotides have been reported. (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

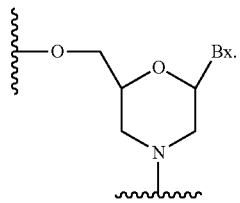

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.*, 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleosides comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purifies, and N-2, N-6 and 0-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propinyl (—C≡C—CH$_3$) uracil, 5-propynylcytosine, 6-azouracil, 6-azacytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N benzoyladenine, 2-N-isobutyrylguanine, 4-N-benzoylcytosine, 4-N-benzoyluracil, 5-methyl 4-N-benzoylcytosine, methyl 4-N-benzoyluracil, universal bases, hydrophobic bases, promiscuous bases, size-expanded bases, and fluorinated bases. Further modified nucleobases include tricyclic pyrimidines, such as 1, diazaphenoxazine-2-one, 1,3-di azaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deazaadenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T, and Lebleu, B., Eds., CRC Press, 1993, 273-288; and those disclosed in Chapters 6 and 15, *Antisense Drug Technology*, Crooke S. T., Ed., CRC Press, 2008, 163-166 and 442443.

Publications that teach the preparation of certain of the above noted modified nucleobases as well as other modified nucleobases include without limitation, Manoharan et al., 052003/0158403; Manoharan et al., 052003/0175906; Dinh et al., U.S. Pat. No. 4,845,205; Spielvogel et al., U.S. Pat. No. 5,130,302; Rogers et at, U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al. U.S. Pat. No. 5,484,908; Matteucci et al., U.S. Pat. No. 5,502,177; Hawkins et al., U.S. Pat. No. 5,525,711; Haralambidis et al., U.S. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al, U.S. Pat. No. 5,645,985; Cook et al., U.S. Pat. No. 5,681,941; Cook et al., U.S. Pat. No. 5,811,534; Cook et al., U.S. Pat. No. 5,750, 692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808, 027; Cook et al., 6,166,199; and Matteucci et al. U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphodiesters, which contain a phosphodiester bond ("P(O$_2$)=O") (also referred to as unmodified or naturally occurring linkages) phosphotriesters, methylphosphonates, phosphonamidates, phosphorothioates ("P(O$_2$)—S"), and phosphorodithioates ("HS—P=S"). Representative non-phosphorus containing internucleoside linking groups include but are not limited to methylenemethylimino (—CH$_2$—N(CH$_3$)—O—CH$_2$—), thiodiester, thionocarbamate (—O—C(=O) (NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphodiester internucleoside linkages can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate internucleoside linkages in particular stereochemical configurations. In certain embodiments, populations of modified oligionucleotides comprise phosphorothioate internucleoside linkages wherein ail of the phosphorothioate internucleoside linkages are stereorandom. Such modified oligonucleotides can be generated using synthetic methods that result in random selection of the stereochemical configuration of leach phosphorothioate internucleoside linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkage in a particular, independently selected stereochemical configuration. In certain embodiments, the particular configuration of the particular phosphorothioate internucleoside linkage is present in at least 65% of the molecules in the population. In certain embodiments, the particular configuration of the particular phosphorothioate internucleoside linkage is present in at least 70% of the molecules in the population. In certain embodiments, the particular configuration of the particular phosphorothioate internucleoside linkage is present in at least 80% of the molecules in the population. In certain embodiments, the particular configuration of the particular phosphorothioate internucleoside linkage is present in at least 90% of the molecules in the population. In certain embodiments, the particular configuration of the particular phosphorothioate internucleoside linkage is present in at least 99% of the molecules in the population. Such chirally enriched populations of modified oligonucleotides can be generated using synthetic methods known in the art, e.g., methods described in Oka et al., *JACS* 2003, 125, 8307, Wan et al. *Nuc. Acid. Res.,* 2014, 42, 13456, and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

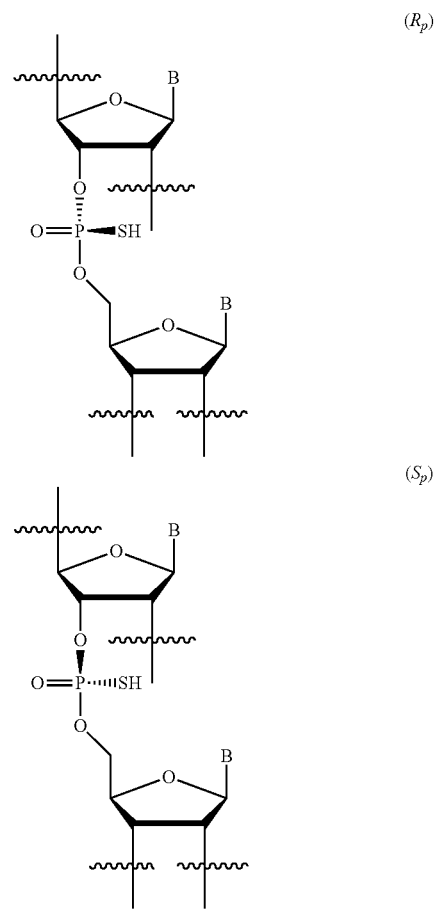

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-$CH_2$—N($CH_3$)—O-5'), amide-3 (3'-$CH_2$—C(=O)—N(H)-5'), amide-4 (3'-$CH_2$—N(H)—C(=O)-5'), formacetal (3'-O—$CH_2$—O-5'), methoxypropyl (MOP), and thioformacetal (3'-S—$CH_2$—O-5'). Further Neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65. Further neutral internucleoside linkages include nonionic linkages comprising mixed N, O, S and $CH_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patients of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Swear Motifs

In certain embodiments, oligonucleotides comprise one or more type of modified sugar and/or unmodified sugar moiety arranged along the oligonucleotide or portion thereof in a defined pattern or sugar motif. In certain instances, such sugar motifs include but are not limited to any of the sugar modifications discussed herein.

In certain embodiments, modified oligonucleotides have a gapmer moth, which is defined by two external regions or "wings" and a central or internal region or "gap." The three regions of a gapmer motif (the 5'-wing, the gap, and the 3'-Ring) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighbouring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or moue other nucleosides of the gap. In certain embodiments, the sugar motifs of the two wings are the same as one another (symmetric gapmer. In certain embodiments, the sugar motif of the 5'-wing differs from the sugar motif of the 3-wing (asymmetric gapmer).

In certain embodiments, the wings of a gapmer comprise 1-6 nucleosides. In certain embodiments, each nucleoside of each wing of a gapmer comprises a modified sugar moiety. In certain embodiments, at least one nucleoside of each wing of a gapmer comprises a modified sugar moiety. In certain embodiments, at least two nucleosides of each wing of a gapmer comprises a modified sugar moiety. In certain embodiments, at least three nucleosides of each wing of a gapmer comprises a modified sugar moiety. In certain embodiments, at least four nucleosides of each wing of a gaper comprises a modified sugar moiety. In certain embodiments, at least five nucleosides of each wing of a gapmer comprises a modified sugar moiety.

In certain embodiments, the gap of a gapmer comprises 7-12 nucleosides. In certain embodiments, each nucleoside of the gap of a gapmer comprises a 2'-deoxyribosyl sugar moiety. In certain embodiments, at least six nucleosides of the gap of a gapmer comprise a 2'-β-D-deoxyribosyl sugar moiety. In certain embodiments, each nucleoside of the gap of gapmer comprises a 2'-β-D-deoxyribosyl sugar moiety. In certain embodiments, at least one nucleoside of the gap of a gapmer comprises a modified sugar moiety. In certain embodiments, at least one nucleoside of the gap of a gapmer comprises a 2'-OMe sugar moiety.

In certain embodiments, the gapmer is a deoxy gapmer. In certain embodiments, the nucleosides on the gap side of each wing/gap junction comprise 2-deoxyribosyl sugar moieties and the nucleosides on the wing sides of each wing/gap junction comprise modified sugar moieties. In certain embodiments, at least six nucleosides of the gap of a gapmer comprise a 2'-β-D-deoxyribosyl sugar moiety. In certain embodiments, each nucleoside of the gap of a gapmer comprises a 2'-deoxyribosyl sugar moiety. In certain embodiments, each nucleoside of each wing of a gapmer comprises a modified sugar moiety. In certain embodiments, one nucleoside of the gap comprises a modified sugar moiety and each remaining nucleoside of the gap comprises a 2'-deoxyribosyl sugar moiety.

In certain embodiments, modified oligonucleotides comprise or consist of a portion having a fully modified sugar motif. In such embodiments, each nucleoside of the fully modified portion of the modified oligonucleotide comprises a modified sugar moiety. In certain embodiments, each nucleoside of the entire modified oligonucleotide comprises a modified sugar moiety. In certain embodiments, modified oligonucleotides comprise or consist of a portion having a fully modified sugar motif, wherein each nucleoside within the fully modified portion comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified oligonucleotide comprises the same 2'-modification.

Herein, the lengths (number of nucleosides) of the three mg ions of a gapmer may be provided using the notation [# of nucleosides in the 5'-wing]-[# of nucleosides in the gap]-[# of nucleosides in the 3'-wing]. Thus, a 10-5 miner consists of 5 linked nucleosides in each wing and 10 linked nucleosides in the gap. Where such nomenclature is followed by a specific modification, that modification is the modification in each sugar moiety of each wing and the gap nucleosides comprises a 2'-β-D-deoxyribosyl sugar moiety. Thus, a 5-10-5 MOE gapmer consists of 5 linked 2'-MOE nucleosides in the 5'-wing, 10 linked 2'-β-D-deoxynucleosides in the gap, and 5 linked 2'-MOE nucleosides in the 3'-wing. A 3-10-3 cEt gapmer consists of 3 linked cEt nucleosides in the 5'-wing, 10 linked 2'-β-D-deoxynucleosides in the gap, and 3 linked cEt nucleosides in the 3'-wing. A 5-8-5 gapmer consists of 5 linked nucleosides comprising a modified sugar moiety in the 5'-wing, 8 linked 2'-β-D-deoxynucleosides in the gap, and 5 linked nucleosides comprising a modified sugar moiety in the 3'-wing. A mixed wing gapmer has at least two different modified sugar moieties in the 5'- and/or the 3'-wing. A 5-8-5 or 5-8-4 mixed wing gapmer has at least two different modified sugar moieties in the 5'- and/or the 3'-wing.

In certain embodiments, modified oligonucleotides are 5-10-5 MOE gapmers. In certain embodiments, modified oligonucleotides are 4-10-6 MOE gapmers. In certain embodiments, modified oligonucleotides are 6-104 MOE gapmers. In certain embodiments, modified oligonucleotides are 4-8-6 MOE gapmers. In certain embodiments, modified oligonucleotides are 6-8-4 MOE gapmers. In certain embodiments, modified oligonucleotides are 5-8-5 MOE gapmers. In certain embodiments, modified oligonucleotides are X-Y-Z MOE gapmers, wherein X and Z are independently selected from 1, 2, 3, 4, 5, 6, or 7 linked 2'-MOE nucleosides and Y is selected from 7, 8, 9, 10, or 11 linked deoxynucleosides.

In certain embodiments, modified oligonucleotides have the following sugar motif (5 to 3'): eeeeedyddddddeeeee, eeeeedddddddddeeeee, eeeeeedddddddddeeee, eeeedddddddddeeeeee, eeeedddddddeeeeee, eeeeedddddddeeee, or eeeeedddddddeeeee, wherein 'd' represents a 2'-deoxyribosyl sugar moiety, 'e' represents a 2'-MOE sugar moiety, and 'y' represents a 2'-OMe sugar moiety.

2. Certain Nucleobase Motifs

In certain embodiments, oligonucleotides comprise modified and/or unmodified nucleobases arranged along the oligonucleotide or portion thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of the nucleoside is a 2'-β-D-deoxyribosyl sugar moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or portion thereof in a defined pattern or motif. In certain embodiments, each internucleoside linking group is a phosphodiester internucleoside linkage (P═O). In certain embodiments, each internucleoside linking group of a modified oligonucleotide is a phosphorothioate internucleoside linkage (P═S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester internucleoside linkage is not a terminal internucleoside linkage, and the remaining internucleoside linkages are phosphorothioate internucleoside linkages. In certain such embodiments, all of the phosphorothioate internucleoside linkages are stereorandom. In certain embodiments, all of the phosphorothioate internucleoside linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

In certain embodiments, modified oligonucleotides have an internucleoside linkage motif of (5' to 3'): sooosssssssssssssss, soooosssssssssssooss, sooooosssssssss-soss, sooosssssssssooss, sooGGGGGsssooss, sooosssssssssoss, or sooosssssssssooss, wherein each "s" represents a phosphorothioate internucleoside linkage and each "o" represents a phosphodiester internucleoside linkage.

C. Certain Lengths it is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target nucleic acid in an oocyte injection model. Oligonucleotides 25 nucleobases in length with 8 or 11 mismatch bases near the ends of the oligonucleotides were able to direct specific cleavage of the target nucleic acid, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y an each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 ID 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 23, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 23, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both ti-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a portion of an oligonucleotide has a nucleobase sequence that is complementary to a second oligonucleotide or an identified reference nucleic acid, such as a target nucleic acid. In certain embodiments, the nucleobase sequence of a portion or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups for terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, abasic nucleosides, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Biorg. Med. Chem. Lett.,* 1994, 4, 1053-1060), a thioether, e.g., hexyl-S-tritylthiol (Manoharan et al., *Ann. N.Y. Acad. Sci.,* 1992, 00, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chairs, e.g., do-decan-dial or undecyl residues (Saison-Behmoaras et al., *EMBO J.,* 1991, 10, 1111-1118; Kabanov et al., *FEBS Lett.,* 1990, 259, 127-330; Svinarchuk et al., *Biochimie,* 1993, 75, 49-54), a phospholipid, e.g., di-hexadecyl-roc-glycerol or triethyl-ammonium 1,2-di-O-hexadecyl-rac-glycero-3-H-phosphonate (Manoharan et al., *Tetrahedron Lett.,* 1995, 36, 3651-1654; Shea et al., *Nucl. Acids Res.,* 1990, 18, 3777-3783), a polyamine or a polyethylene glycol chairs (Manoharan et al., *Nucleosides & Nucleotides,* 1995, 14, 969473), or adamantine acetic acid a palmityl moiety (Mishra et al., *Biochim. Biophys. Acta,* 1995, 1264, 229-237), an octadecylamine or hexylaminocarbonyl-oxycholesterol moiety (Crooke et al., *J. Pharmacol. Exp. Ther.,* 1996, 277, 923-937), a tocopherol group (Nishina et al., *Molecular Therapy Nucleic Acids,* 2015, 4, e220; and Nishina et al., *Molecular Therapy,* 2008, 16, 734-740), or a N-acetylgalactosamine (GalNAc) cluster (e.g., 020141179620).

In certain embodiments, conjugate groups may be selected from any of a C22 alkyl, C20 alkyl, C16 alkyl, C10 alkyl, C21 alkyl, C19 alkyl, C18 alkyl, $C_{1-5}$ alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl.

In certain embodiments, conjugate groups may be selected from any of C22 alkyl, C20 alkyl, C16 alkyl, C10 alkyl, C21 alkyl, C19 alkyl, C18 alkyl, C15 alkyl, C14 alkyl, C13 alkyl, C12 alkyl, CU alkyl, C9 alkyl, C8 alkyl, C7 alkyl, C6 alkyl, and C5 alkyl, where the alkyl chain has one or more unsaturated bonds.

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, lipophilic groups, phospholipids, biotin, phebutazine, phenanthridine, anthraquinone, adamantane, acridine, fluorescein, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethidin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain oligomeric compounds, a conjugate moiety is attached to an oligonucleotide via a more complex conjugate linker comprising one or more conjugate linker moieties, which are sub units making up a conjugate linker. In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamine. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate tinkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site of a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are DOE limited to pyrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 140 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 4-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 4-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least are cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbanilate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate or phosphodiester linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2-deoxynucleoside that is attached to either the 3' or 5'-terminal nucleoside of an oligonucleotide by a phosphodiester internucleoside linkage and covalently attached to the remainder of the conjugate linker or conjugate moiety by a phosphate or phosphorothioate internucleoside linkage. In certain such embodiments, the cleavable moiety is 2-deoxyadenosine.

3. Cell-Targeting Moieties

In certain embodiments, a conjugate group comprises a cell-targeting moiety. In certain embodiments, a conjugate group has the general formula:

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a portion complementary to a target nucleic acid and a second oligomeric compound having a portion complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an of oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce the amount or activity of a target nucleic acid by 25% or more in the standard cell assay. In certain embodiments, antisense compounds selectively affect one or more target nucleic acid.

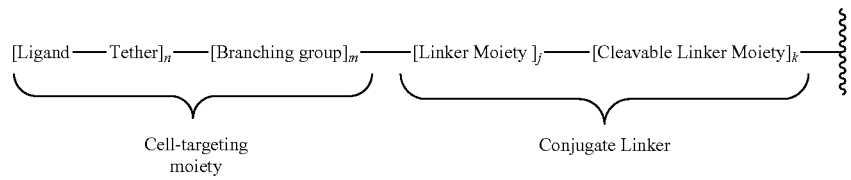

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphonates, including, but not limited to 5'-vinylphosphonates. In certain embodiments, terminal groups comprise one or mote abasic nucleosides and/or inverted nucleosides. In certain embodiments, terminal groups comprise one or more 2'-linked nucleosides. In certain such embodiments, the 2'-linked nucleoside is an abasic nucleoside.

Stich antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISE), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or subject.

V. Certain Target Nucleic Acids

In certain embodiments, oligomeric compounds comprise or consist of an oligonucleotide comprising a portion that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target nucleic acid is a mature mRNA. In certain embodiments, the target nucleic acid is a pre-mRNA. In certain embodiments, the target region is entirely within an intron. In certain embodiments, the target region spans an intron/exon junction. In certain embodiments, the target region is at least 50% within an intros.

A. Complementarity/Mismatches to the Target Nucleic Add

It is possible to introduce mismatch bases without eliminating activity. For example. Gautschi et al (J. Natl. Cancer Inst. 93:463-471, March 2001) demonstrated the ability of an oligonicleotide having 100% complementarily to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides an complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a portion that is 100% or fully complementary to a target nucleic acid. In certain embodiments, the portion of frill complementarily is 6, 7, 8, 9, 10, 11, 12, 13, 14, 15, 16, 17, 18, 19, 20, 21, 22, 23, or 24 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, 8, 9, 10, or 11 from the 5'-end of the gap region. In certain embodiments, the mismatch is at position 1, 2, 3, 4, 5, or 6 from the 5'-end of the 5' wing region or the 3' wing region.

B. SCN2A

In certain embodiments, oligomeric compounds comprise or consist of an oligonucleotide that is complementary to a target nucleic acid, wherein the target nucleic acid is an SCN2A nucleic acid. In certain embodiments, the SCN2A nucleic acid has the sequence set forth in SEQ ID NO: 1 (GENBANK Accession No. NM_001040142.2) or SEQ ID NO: 2 (GENBANK Accession No. NC_000002.12 truncated from nucleotides 165127001 to 165395000).

In certain embodiments, contacting a cell with an oligomeric compound complementary to SEQ ID NO: 1 or SEQ ID NO: 2 reduces the amount of SCN2A RNA in a cell, and in certain embodiments reduces the amount of SCN1A protein in a cell. In certain embodiments, contacting a cell with a modified oligonucleotide complementary to SEQ ID NO: 1, or SEQ ID NO: 2 reduces the amount of SCN2A RNA in a cell, and in certain embodiments reduces the amount of SCN2A protein in a cell. In certain embodiments, the cell is in vitro. In certain embodiments, the cell is in a subject.

In certain embodiments, the oligomeric compound consists of a modified oligonucleotide. In certain embodiments, contacting a cell in a subject with an oligomeric compound complementary to SEQ ID NO: 1 or SEQ ID NO: 2 ameliorates one or more symptoms or hallmarks of a disease or disorder associated with a voltage-gated sodium channel protein. In certain embodiments, the voltage-gated sodium channel protein is SCN2A. In certain embodiments, the subject has a disease or disorder associated with a voltage-gated sodium channel protein that is not SCN2A. In certain embodiments, the subject has a disease or disorder associated with SCN1A. In certain embodiments, the disease or disorder is a Developmental or Epileptic Encephalopathy, such as Early Seizure Onset Epileptic Encephalopathy, Late Seizure Onset Epileptic or Encephalopathy, Benign Familial Neonatal-Infantile Seizures: in certain embodiments, the disease or disorder is an intellectual disability or an autism spectrum disorder; in certain embodiments, the disease or disorder is Dravet Syndrome.

In certain embodiments, the symptom or hallmark is any of seizures, hypotonia, sensory integration disorders, motor dysfunctions, intellectual and cognitive dysfunctions, movement and balance dysfunctions, visual dysfunctions, delayed language and speech, gastrointestinal disorder for example, gastroesophageal reflux, diarrhea, constipation, dysmotility, and the like), neurodevelopmental delays, sudden unexpected death in epilepsy, motor development delays, delayed social and language milestones, repetitive actions, uncoordinated oral movements, and sleep problems. In certain embodiments, the seizures are any of focal, clonic, tonic, and generalized tonic and clonic seizures, prolonged seizures (often lasting longer than 10 minutes), and frequent seizures (for example, convulsive, myoclonic, absence, focal, obtundation status, and tonic seizures).

In certain embodiments, an oligomeric compound complementary to SEQ ID NO: 1 or SEQ ID NO: 2 is capable of reducing the detectable amount of SCN2A RNA in vitro by at least 10%, at least 20%, at least 30%, at least 40%, at least 50%, at least 60%, at least 70%, at least 80%, or at least 90% in the standard in vitro assay. In certain embodiments, an oligomeric compound complementary to SEQ ID NO: 1 or SEQ ID NO: 2 is capable of reducing the detectable amount of SCN2A protein in vitro by at least 10%, at least 20%, at least 30%, at least 40%, at least 50%, at least 60%, at least 70%, at least 80%, or at least 90% in the standard in vitro assay. In certain embodiments, an oligomeric compound complementary to SEQ if) NO: 1 or SEQ ID NO: 2 is capable of reducing the detectable amount of SCN2A RNA in vivo by at least 10%, at least 20%, at least 30%, at least 40%, at least 50%, at least 60%, at least 70% at least 80% or at least 90% when administered according to the standard in vivo assay. In certain embodiments, an oligomeric compound complementary to SEQ ID NO: 1 or SEQ ID NO: 2 is capable of reducing the detectable amount of SCN2A protein in vivo by at least 10%, at least 20%, at least 30%, at least 40%, at least 50%, at least 60%, at least 70%, at least 80%, or at least 90% when administered according to the standard in vivo assay. In certain embodiments, an oligomeric compound complementary to SEQ ID NO: 1 or SEQ ID NO: 2, is capable of reducing the detectable amount of SCN2A RNA in the CSF of a subject by at least 10%, at least 20%, at least 30%, at least 40%, at least 50%, at least 60%, at least 70%, at least 80%, or at least 90%. In certain embodiments, an oligomeric compound complementary to SEQ ID NO: 1 or SEQ ID NO: 2, is capable of reducing the detectable amount of SCN2A protein in the CSF of a subject by at least W %, at least 20%, at least 30%, at least 40%, at least 50%, at least 60%, at least 70%, at least 80%, or at least 90%.

In certain embodiments, oligomeric compounds do not comprise a bicyclic sugar moiety. In certain embodiments, oligomeric compounds do not comprise more than one, two, three, four, five, six, seven, eight, or nine bicyclic sugar moieties. In certain embodiments, oligomeric compounds comprise one or two wing segments that comprise a nucleoside that is no a bicyclic nucleoside. In certain embodiments, oligomeric compounds do not comprise a LNA sugar moiety. In certain embodiments, oligomeric compounds do not comprise more than one, two, three, four, five, six, seven, eight, or nine LNA sugar moieties. In certain embodiments, oligomeric compounds comprise one or two wing segments that comprise a nucleoside that is not a LNA nucleoside.

Certain Tame Nucleic Acids in Certain Tissues

In certain embodiments, oligomeric compounds comprise or consist of an oligonucleotide comprising a portion that is complementary to a target nucleic acid, wherein the target nucleic acid is expressed in a pharmacologically relevant tissue. In certain embodiments, the pharmacologically relevant tissues am the cells and tissues that comprise the central nervous system. Such tissues include the cortex, hippocampus, and spinal cord.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid ("artificial CSF" or "aCSF"). In certain embodiments, the artificial cerebrospinal fluid is pharmaceutical guide.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to a subject, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiment's, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents comprising an oligomeric compound provided herein to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VP) co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: fear example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administrations by injection (e.g., intravenous, subcutaneous, intramuscular, intrathecal (IT), intracerebroventricular (ICV), intraneural, perineural, etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or sere as preservatives). In certain embodiments, injectable suspensions are prepared using appropriate liquid carriers, suspending agents and the like. Certain pharmaceutical compositions for injection ale presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Under certain conditions, certain compounds disclosed herein act as acids. Although such compounds may be drawn or described in protonated (fire acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist hi an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or salt thereof" expressly includes all such forms that may be fully or partially protonated/de-protonated/in association with a cation. In certain instances, one or more specific cation is identified.

In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In Certain such embodiments, the pH of the solution is adjusted with NaOH and/or HCl to achieve a desired pH.

Herein, certain specific doses are described. A dose may be in the form of a dosage unit. For clarity, a dose (or dosage unit) of a modified oligonucleotide or an oligomeric compound in milligrams indicates the mass of the free acid form of the modified oligonucleotide or oligomeric compound. As described above, in aqueous solution, the free acid is in equilibrium with anionic and salt forms. However, for the purpose of calculating dose, it is assumed that the modified oligonucleotide or oligomeric compound exists as a solvent-free, sodium-acetate free, anhydrous, free acid. For example, where a modified oligonucleotide or an oligomeric compound is in solution comprising sodium (e.g., saline), the modified oligonucleotide or oligomeric compound may be partially or fully de-protonated and in association with Na+ ions. However, the mass of the protons are nevertheless counted toward the weight of the dose, and the mass of the Na+ ions are not counted toward the weight of the dose. Thus, for example, a dose, or dosage unit, of 10 mg of Compound No. 1348259, equals the number of fully protonated molecules that weighs 10 mg. This would be equivalent to 10.59 mg of solvent-free, sodium acetate-flee, anhydrous sodiated Compound No. 1348259. When an oligomeric compound comprises a conjugate group, the mass of the conjugate group is included in calculating the dose of such oligomeric compound. If the conjugate group also has an acid, the conjugate group is likewise assumed to be fully protonated for the purpose of calculating dose.

VII. Certain Compositions

I. Compound No. 1348259

In certain embodiments, Compound No. 1348259 is characterized as a 5-10-5 MOE, gapmer having a sequence (from 5' to 3') of GCATAATCCCATTATACAAA (SEQ ID NO: 2493), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4.4 to 5, 5 to 6, 16 to 17, and 17 to 18 are phosphodiester internucleoside linkages, the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1348259 is represented by the following chemical notation: $G_{es}{}^mC_{eo}A_{eo}T_{eo}A_{eo}A_{ds}T_{ds}{}^mC_{ds}{}^mC_{ds}{}^mC_{ds}A_{ds}T_{ds}T_{ds}A_{ds}T_{ds}A_{eo}{}^mC_{eo}A_{es}A_{es}A_e$ (SEQ ID NO: 2493), wherein:

A=an adenine nucleobase,
$^m$C=a 5-methyl cytosine nucleobase,
G=a guanine nucleobase,
T=a thy mine nucleobase,
e=a 2'-MOE sugar moiety, d=a 2-β-D-deoxyribosyl sugar moiety,
s=a phosphorothioate internucleoside linkage, and
o=a phosphodiester internucleoside linkage.

In certain embodiments, Compound No. 1348259 is represented by the following chemical structure:

Structure 1. Compound No. 1348259

(SEQ ID NO: 2493)

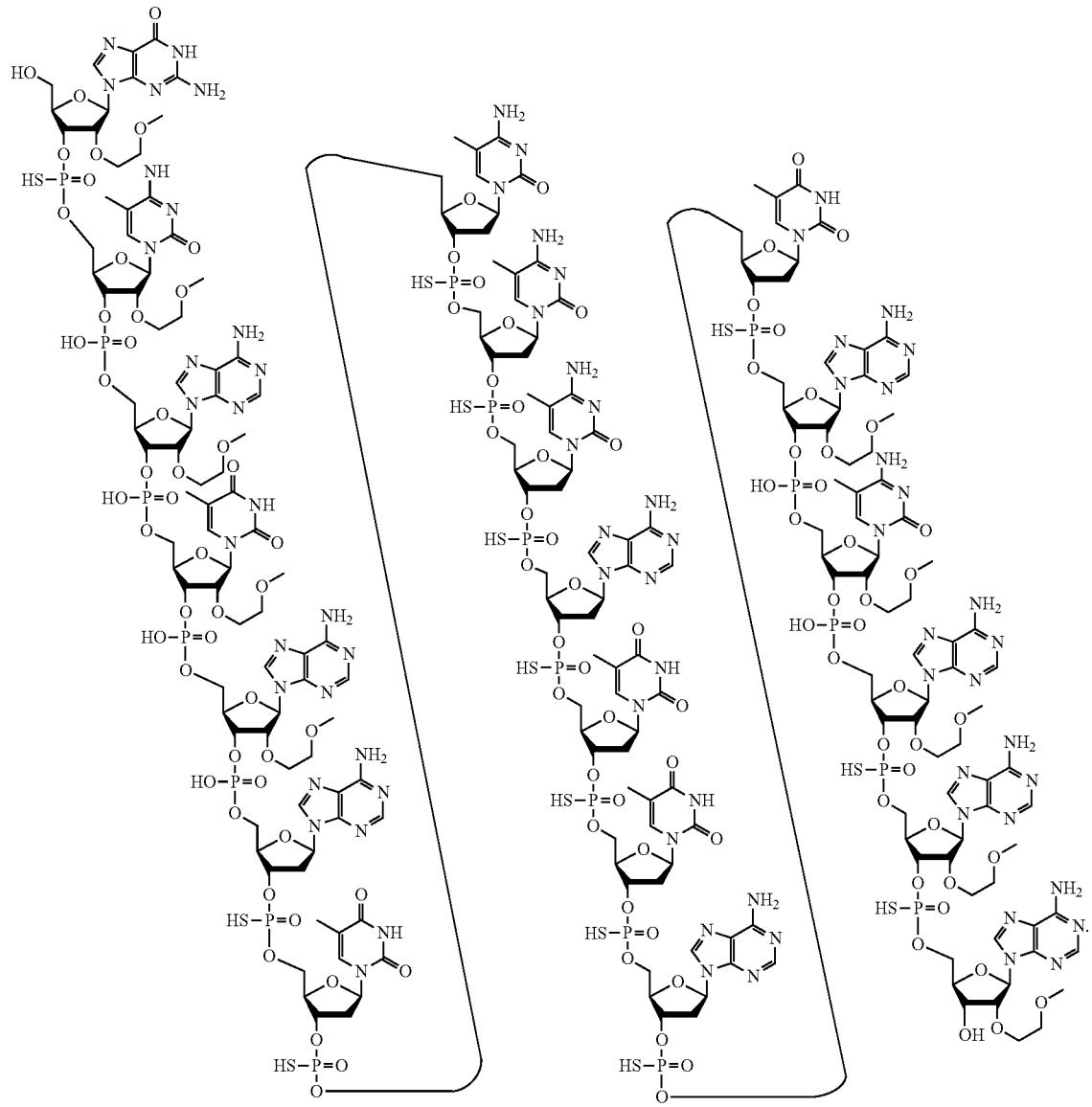

In certain embodiments, the sodium snit or Compound No. 1348259 is represented by the following chemical structure.

Structure 2. The sodium salt of Compound No. 1348259

(SEQ ID NO: 2493)

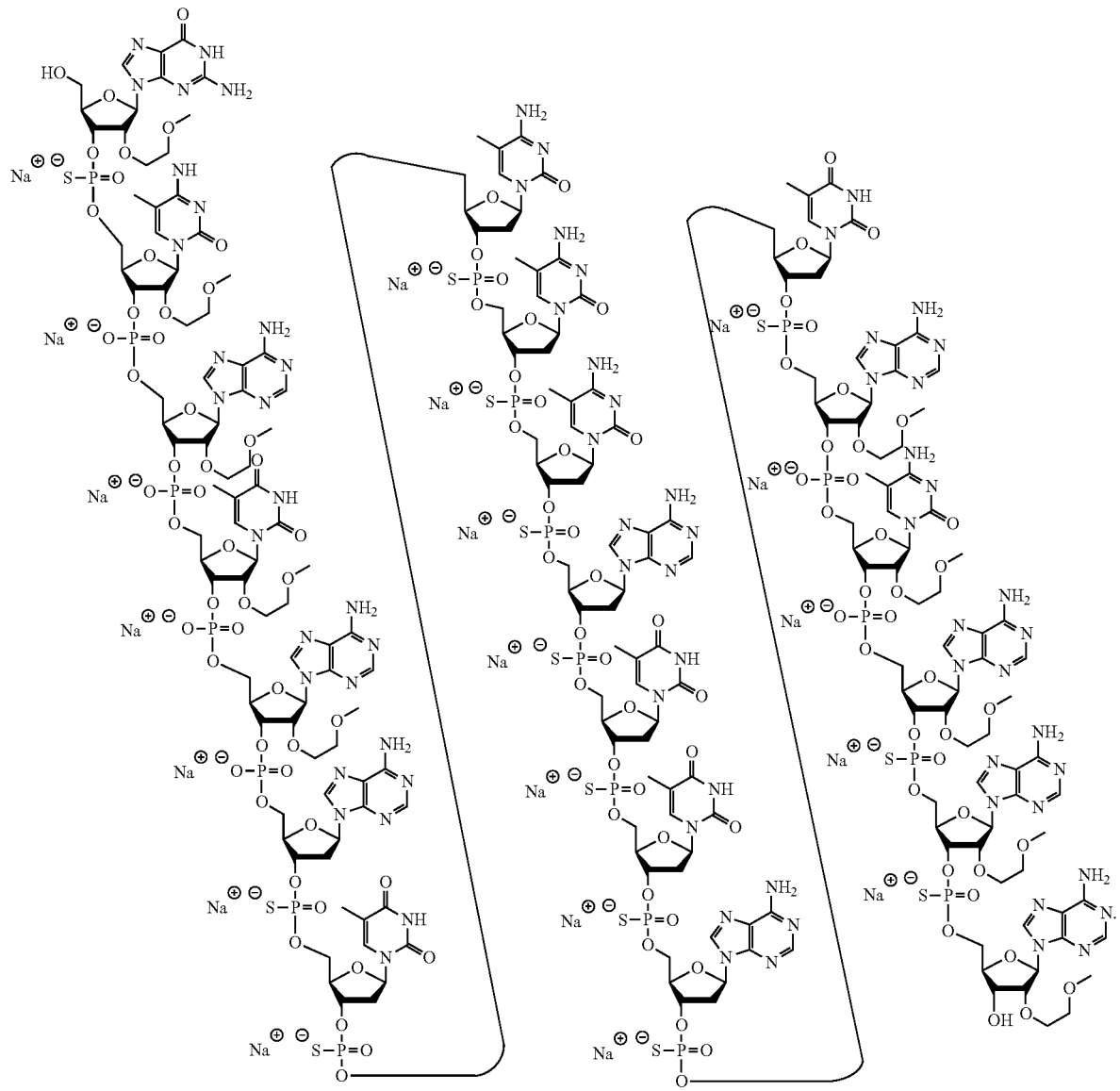

2. Compound No. 1348289

In certain embodiments, Compound No. 1348289 is characterized as a 6-10-4 MOE gapmer having a sequence (from 5' to 3') of CACGACATATTTTCTACAC (SEQ ID NO: 2514), wherein each of nucleosides 1-6 and 17-20 (from 5' to 3') are 2'-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages, the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1348289 is represented by the following chemical notation: $^mC_{es}{}^mC_{eo}A_{eo}{}^mC_{ec}G_{eo}A_{eo}{}^mC_{ds}A_{ds}T_{ds}A_{ds}T_{ds}T_{ds}T_{ds}T_{ds}{}^mC_{ds}T_{eo}A_{es}{}^mC_{es}A_e$(SEQ ID NO: 2514), wherein:

A=an adenine nucleobase.
$^mC$=a 5-methyl cytosine nucleobase,
g=a guanine nucleobase,
t=a thymine nucleobase,
e=a 2'-MOE sugar moiety,
d=a 2'-β-D-deoxyribosyl sugar moiety.
s=a phosphorothioate internucleoside linkage, and
o=a phosphodiester internucleoside linkage.

In certain embodiments, Compound No. 1348289 is represented by the following chemical structure:

Structure 3. Compound No. 1348289
(SEQ ID NO: 2514)
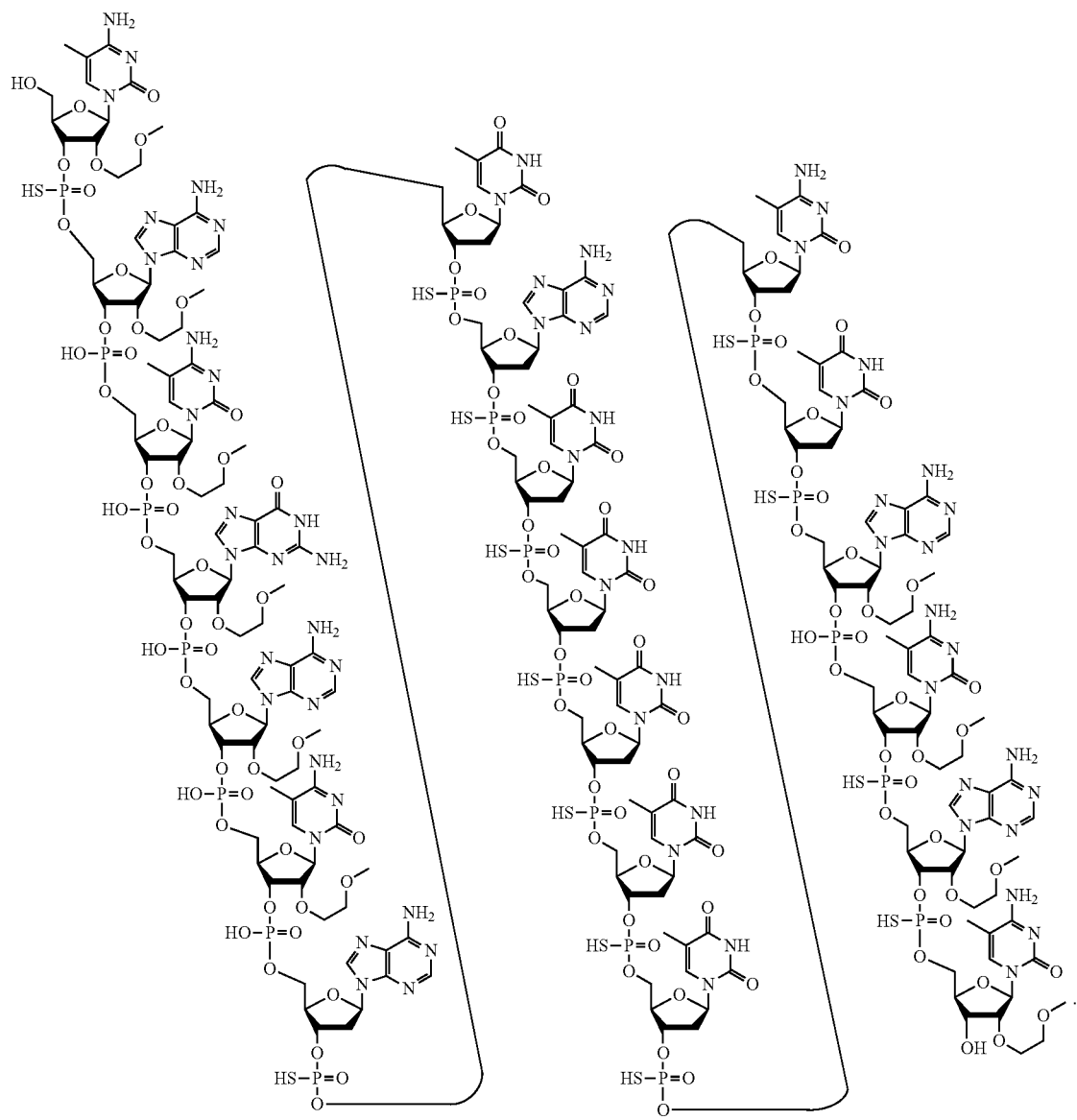
In certain embodiments, the sodium salt of Compound No. 1348289 is represented by the following chemical structure:

Structure 4. The sodium salt of Compound No. 1348289

(SEQ ID NO: 2514)

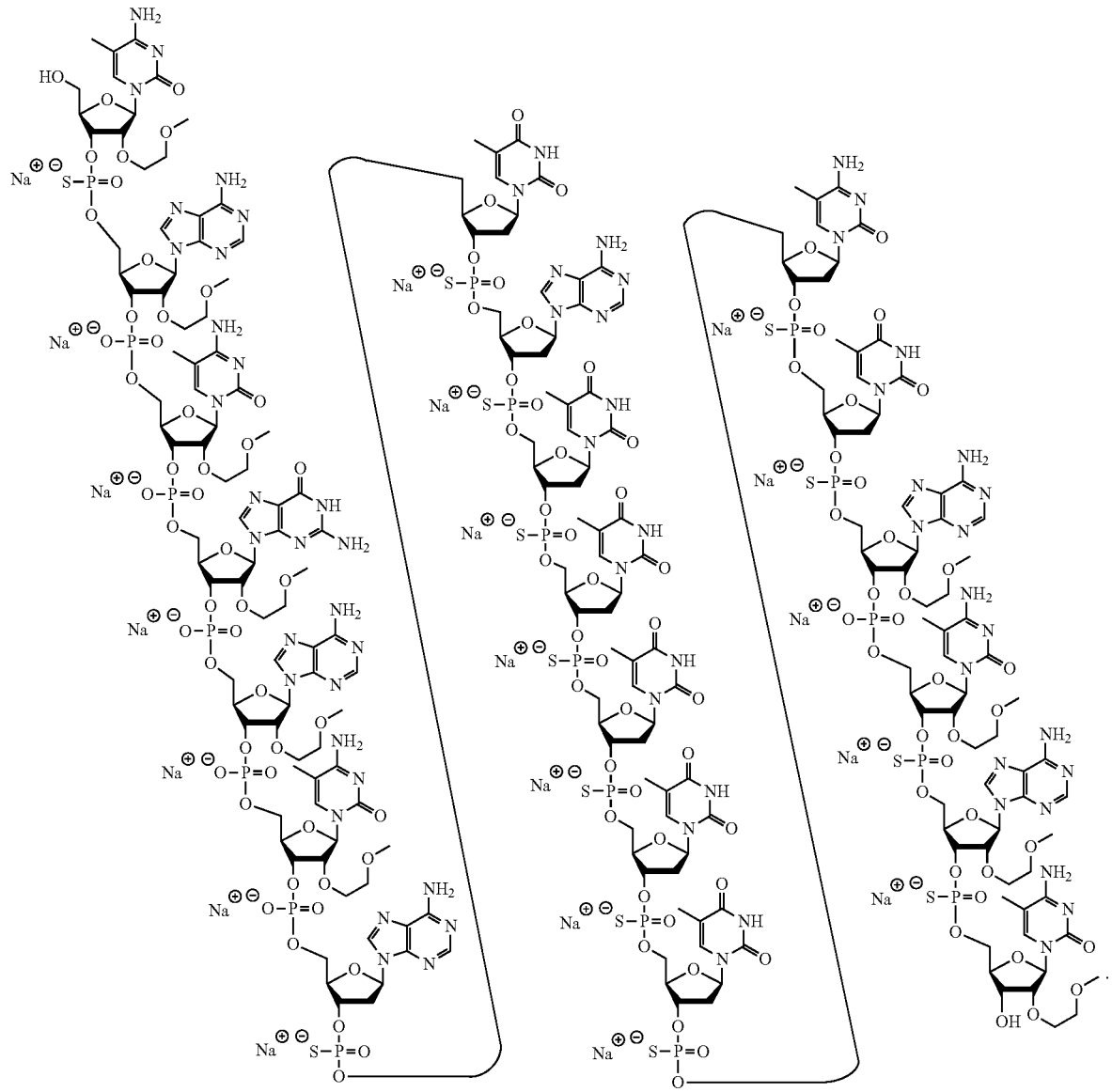

3. Compound No. 1348290

In certain embodiments, Compound No. 1348290 is characterized as a 6-10-4 MOE gapmer having a sequence (from 5' to 3') of CCACGACATATTTTTCTACA (SEQ ID NO: 2510), wherein each of nucleosides 1-6 and 17-20 (from 5' to 3') are 2'-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages, the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphothioate internucleoside linkages, and wherein each cytosine is a 5-methyl cytosine.

In certain embodiments, Compound No. 1348290 is represented by the following chemical notation: $^{m}C_{es}{}^{m}C_{eo}A_{eo}{}^{m}C_{ec}G_{eo}A_{eo}{}^{m}C_{ds}A_{ds}T_{ds}A_{ds}T_{ds}T_{ds}T_{ds}T_{ds}T_{ds}{}^{m}C_{ds}T_{eo}A_{es}{}^{m}C_{es}A_{e}$(SEQ ID NO: 2510), wherein:

A=an adenine nucleobase,
$^{m}C$=a 5-methyl cytosine nucleobase,
G=a guanine nucleobase,
T=a thymine nucleobase,
e=a 2'-MOE sugar moiety.
d=a 2'-β-D-deoxyribosyl sugar moiety,
s=a phosphorothioate internucleoside linkage, and
o=a phosphodiester internucleoside linkage.

In certain embodiments, Compound No. 1348290 is represented by the following chemical structure:

Structure 5 Compound No. 1348290
(SEQ ID NO: 2510)
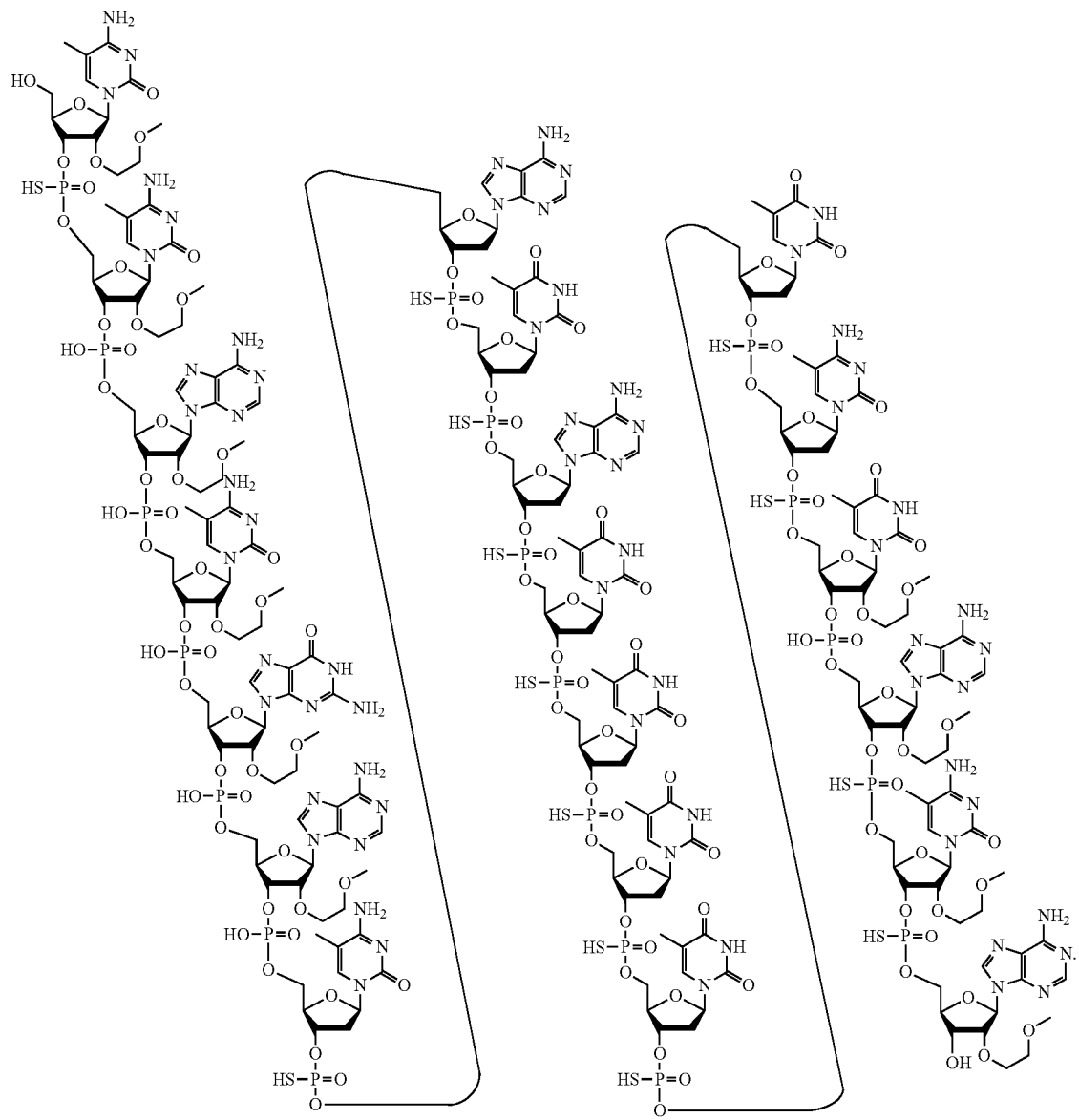
In certain embodiments, the sodium salt of Compound No. 1348290 is represented by the following chemical structure:

Structure 6 The sodium salt of Compound No. 1348290

(SEQ ID NO: 2510)

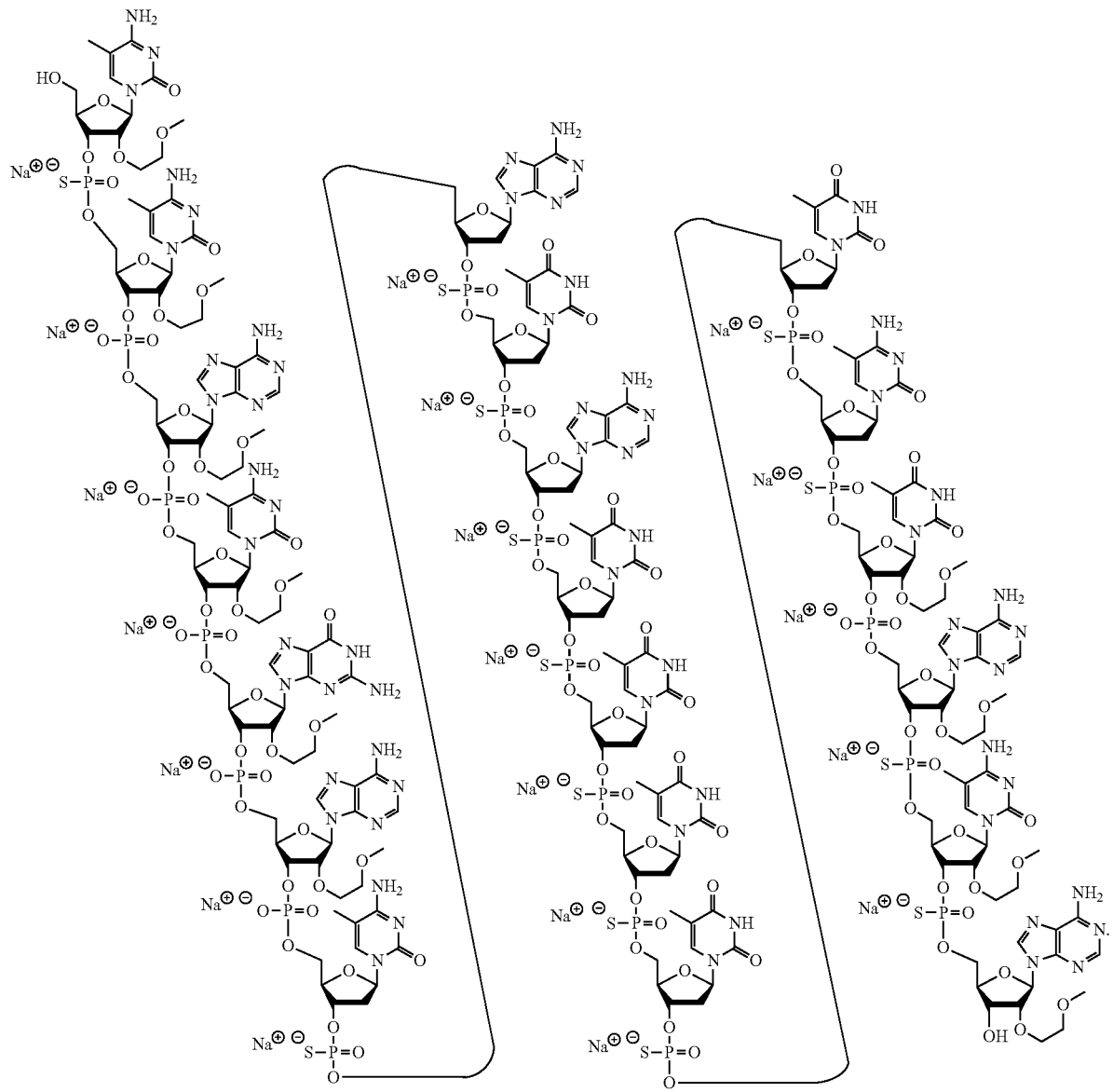

4. Compound No. 1348331

In certain embodiments, Compound No. 1348331 is characterized as a 6-10-4 MOE gapmer having a sequence (from 5' to 3') of TCTGCATGTAACCTTTATAC (SEQ ID NO: 2487), wherein each of nucleosides 1-6 and 17-20 (from 5' to 3') are 2'-MOE nucleosides and each of nucleosides 7-16 an 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages, the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

In certain embodiments, Compound No. 1348331 is represented by the following chemical notation: $T_{es}{}^mC_{eo}\text{-}$ $T_{eo}G_{eo}{}^mC_{eo}A_{eo}T_{ds}G_{ds}T_{ds}A_{ds}A_{ds}{}^mC_{ds}{}^mC_{ds}T_{ds}T_{ds}T_{ds}A_{eo}T_{es}$ $A_{es}{}^mC_{e}$ (SEQ ID NO: 2487), wherein:

A=an adenine nucleobase, $^mC$=a 5-methyl cytosine nucleobase,

G=a guanine nucleobase,

T=a thymine nucleobase, e=a 2'-MOE sugar moiety.

d=a 2'-β-D-deoxyribosyl sugar moiety, s=a phosphorothioate internucleoside linkage, and o=a phosphodiester internucleoside linkage.

In certain embodiments, the sodium salt of Compound No. 1348331 is represented by the following chemical structure:

Structure 7 Compound No. 1348331
(SEQ ID NO: 2487)
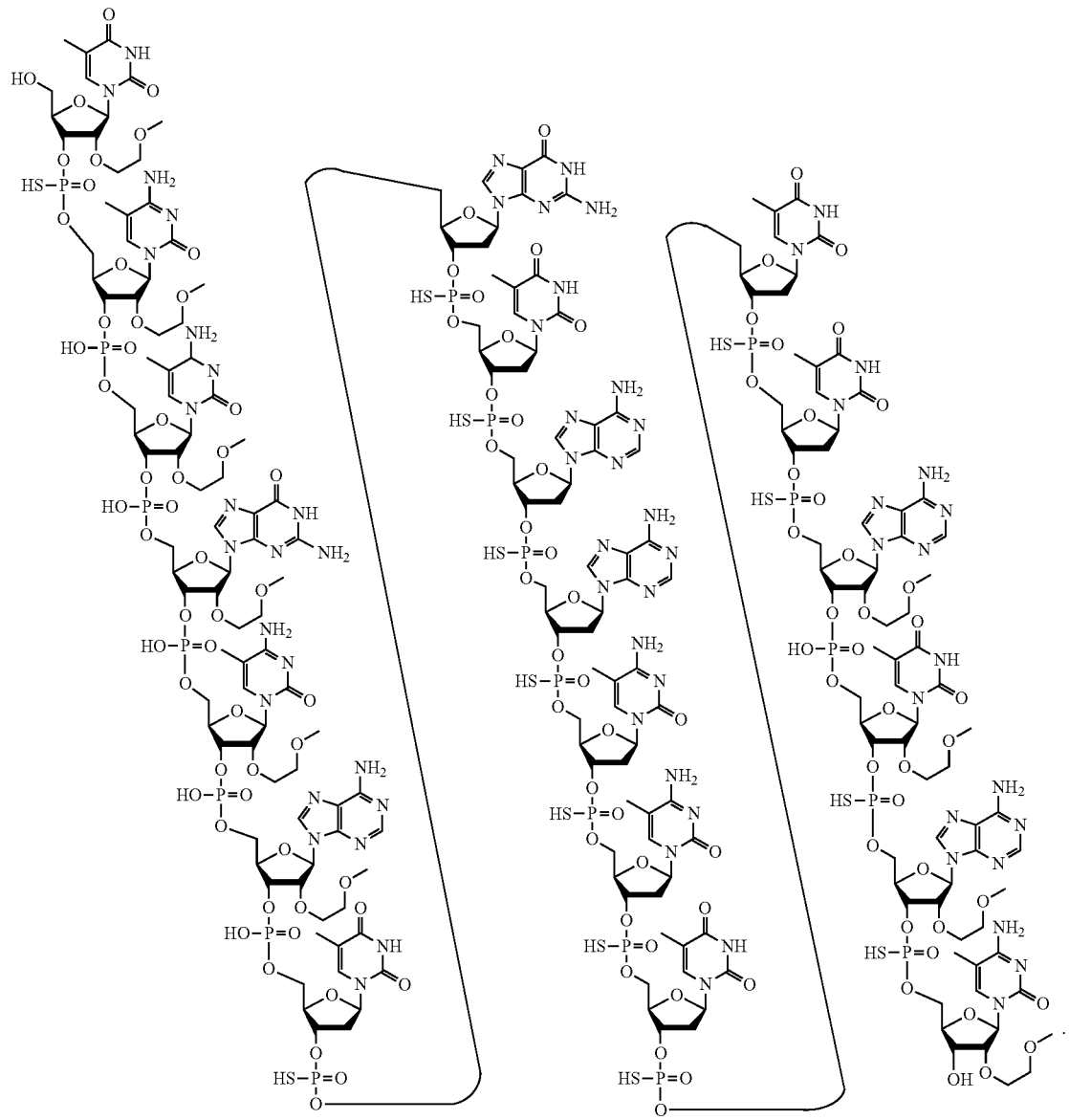
In certain embodiments, the sodium salt of Compound No. 1348331 is represented by the following chemical structure:

Structure 8 The sodium salt of Compound No. 1348331

(SEQ ID NO: 2487)

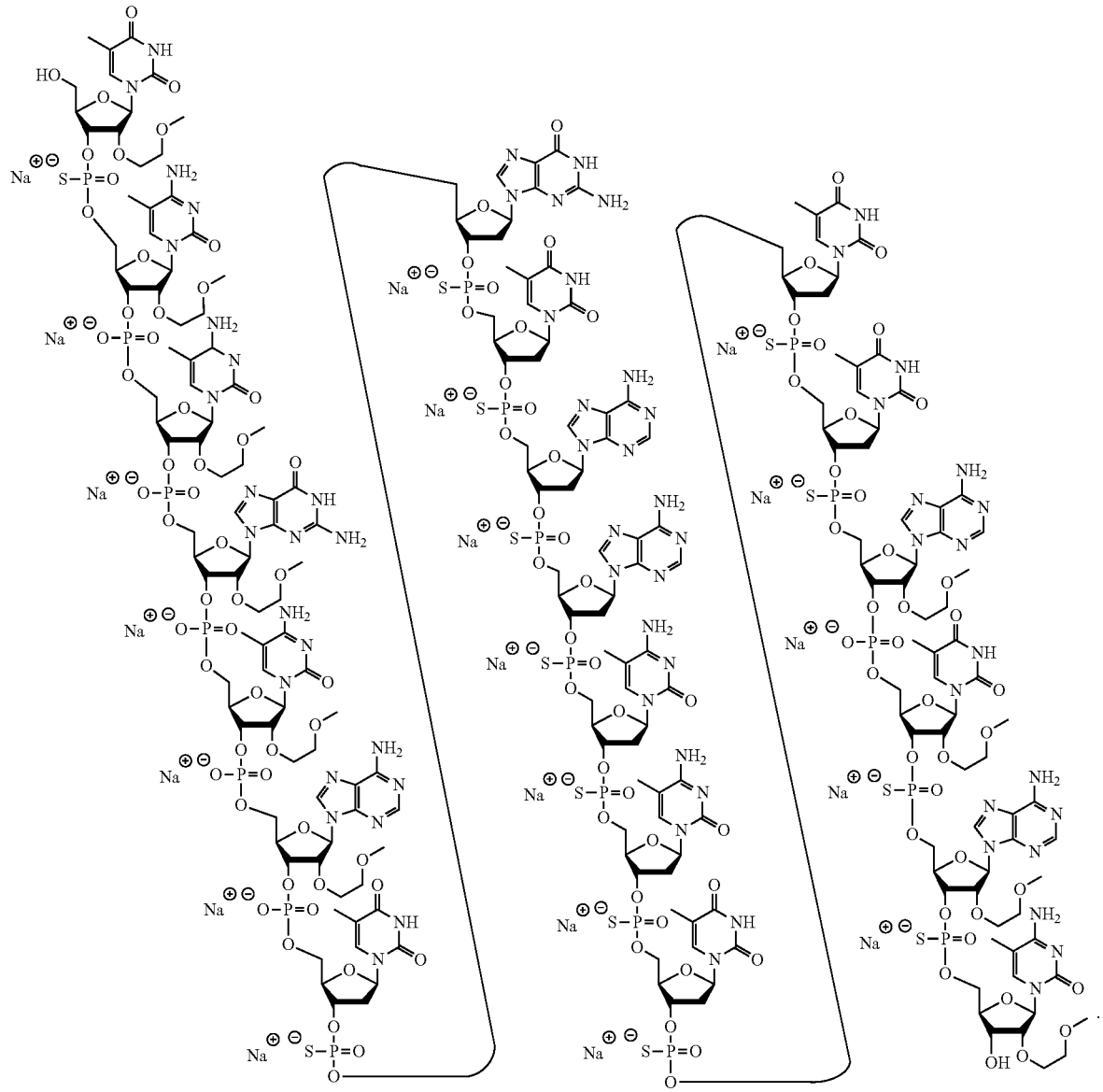

5. Compound No. 1348347

In certain embodiments, Compound No. 1348347 is characterized as a 6-10-4 MOE gapmer having a sequence (from 5' to 3') of GCATAATCCCATTATACAAA (SEQ ID NO: 2493), wherein each of nucleosides 1-6 and 17-20 (from 5' to 3') are 2'-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages, the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphonthioate internucleoside linkages, and wherein each cytosine is a 5-methyl cytosine.

In certain embodiments, Compound No. 1348347 is represented by the following chemical notation: $G_{es}{}^{m}C_{eo}A_{eo}T_{eo}A_{eo}A_{ds}T_{ds}{}^{m}C_{ds}{}^{m}C_{ds}{}^{m}C_{ds}A_{ds}T_{ds}T_{ds}A_{ds}T_{ds}A_{eo}{}^{m}C_{eo}A_{es}A_{es}A_{e}$(SEQ ID NO: 2493), wherein:

A=an adenine nucleobase.
$^{m}$C=a 5-methyl cytosine nucleobase,
G=a guanine nucleobase,
T=a thymine nucleobase,
e=a 2'-MOE sugar moiety,
d=a 2'-β-D-deoxyribosyl sugar moiety.
s=a phosphorothioate internucleoside linkage, and
o=a phosphodiester internucleoside linkage.

In certain embodiments, Compound No. 1348347 is represented by the following chemical structure:

Structure 9 Compound No. 1348347
(SEQ ID NO: 2493)
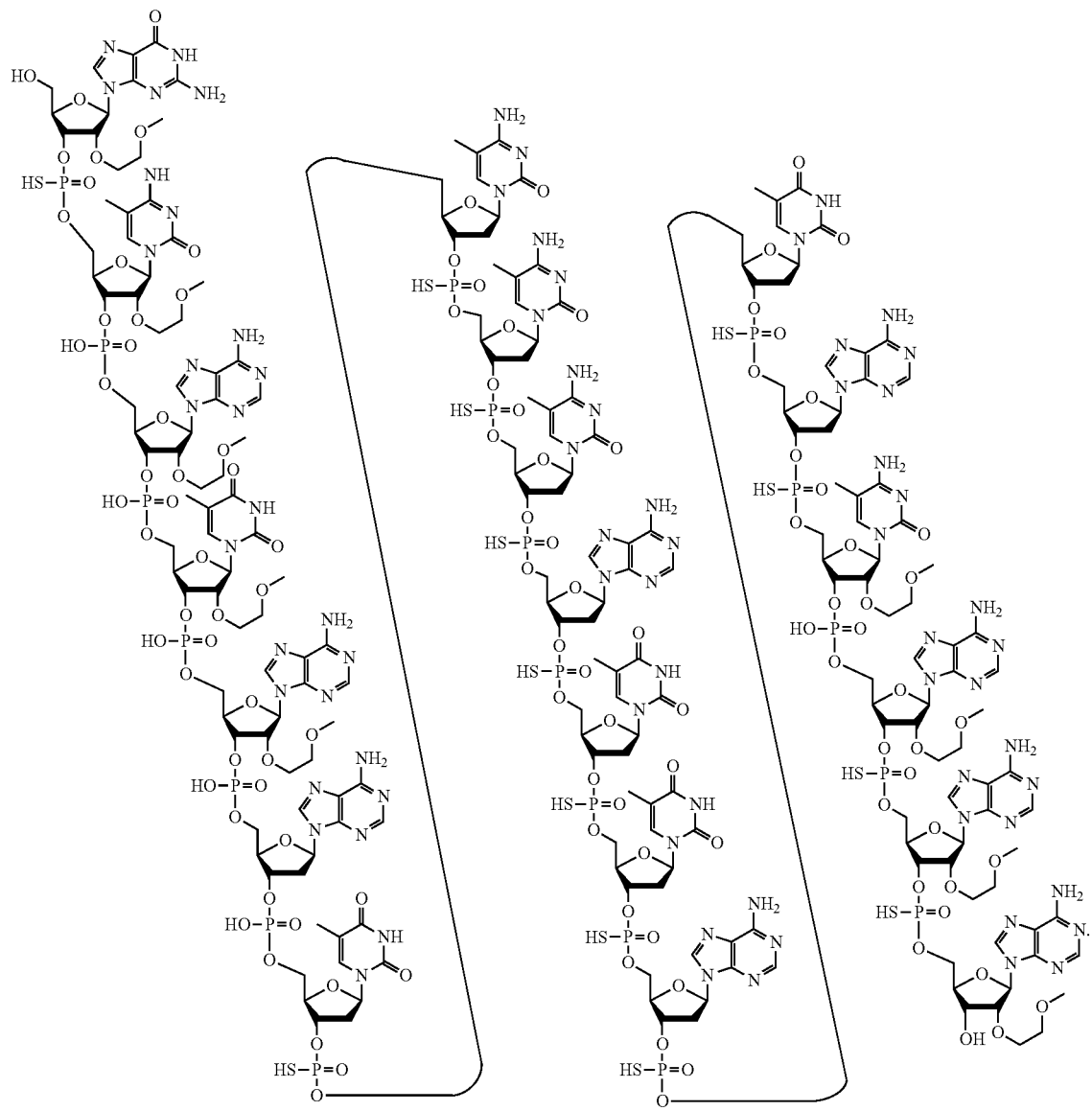
In certain embodiments, the sodium salt of Compound No. 1348347 is represented by the following chemical structure:

Structure 10 The sodium salt of Compound No. 1348347

(SEQ ID NO: 2493)

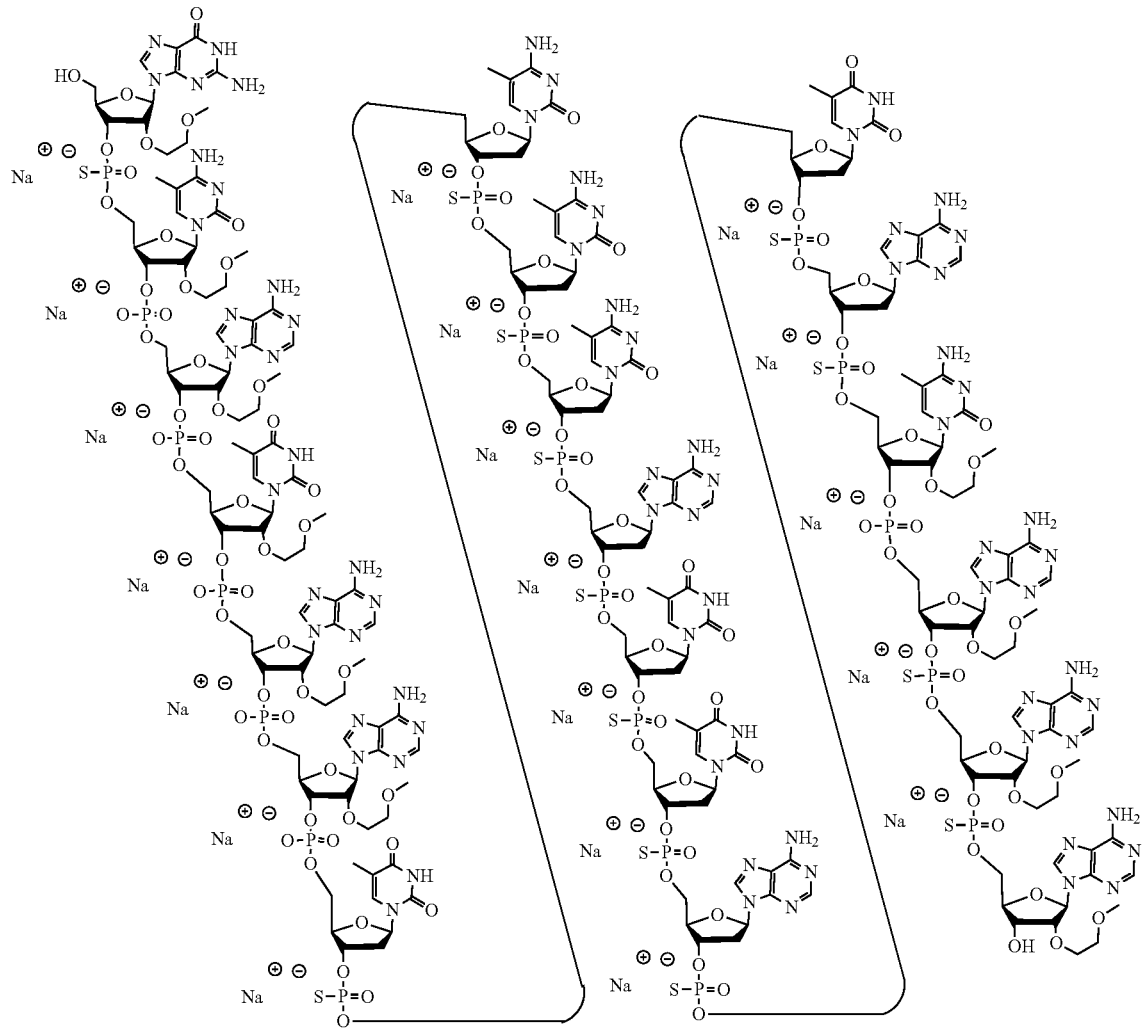

6. Compound No. 1348937

In certain embodiments, Compound No. 1348937 is characterized as a 5-8-5 MOE gapmer having a sequence (from 5' to 3') of CTGCATGTAACCTTTATA (SEQ. ID NO: 2534), wherein each of nucleosides 1-5 and 14-18 (from 5' to 3') are 2'-MOE nucleosides and each of nucleosides 6-13 are 2'-β-D-deoxynucleosides, wherein the internucleoside linkages between nucleosides 2 to 3, 3 to 4, 4 to 5, 14 to 15 and 15 to 16 are phosphodiester internucleoside linkages, the internucleoside linkages between nucleosides 1 to 2; 5 to 6, 6 to 7, 7 to 8, 8 to 9; 9 to 10, 10 to 11, 11 to 12, 12 to 13, 13 to 14, 16 to 17, and 17 to 18 are phosphorothioate internucleoside linkages, and wherein each cytosine is a 5-methyl cytosine.

In certain embodiments, Compound No. 1348937 is represented by the following chemical notation: $^{m}C_{es}T_{eo}G_{eo}{}^{m}C_{eo}A_{es}T_{ds}G_{ds}T_{ds}A_{ds}T_{ds}{}^{m}C_{ds}{}^{m}C_{ds}T_{ds}T_{eo}T_{eo}A_{eo}T_{es}A_{e}$ (SEQ ID NO: 2534), wherein:

A=an adenine nucleobase, $^{m}$C=a 5-methyl cytosine nucleobase,

G=a guanine nucleobase,

T=a thymine nucleobase, e=a 2'-MOE sugar moiety.

d=a 2'-β-D-deoxyribosyl sugar moiety, s=a phosphorothioate internucleoside linkage, and o=a phosphodiester internucleoside linkage.

In certain embodiments, Compound No. 1348937 is represented by the following chemical structure:

Structure 11 Compound No. 1348937
(SEQ ID NO: 2534)
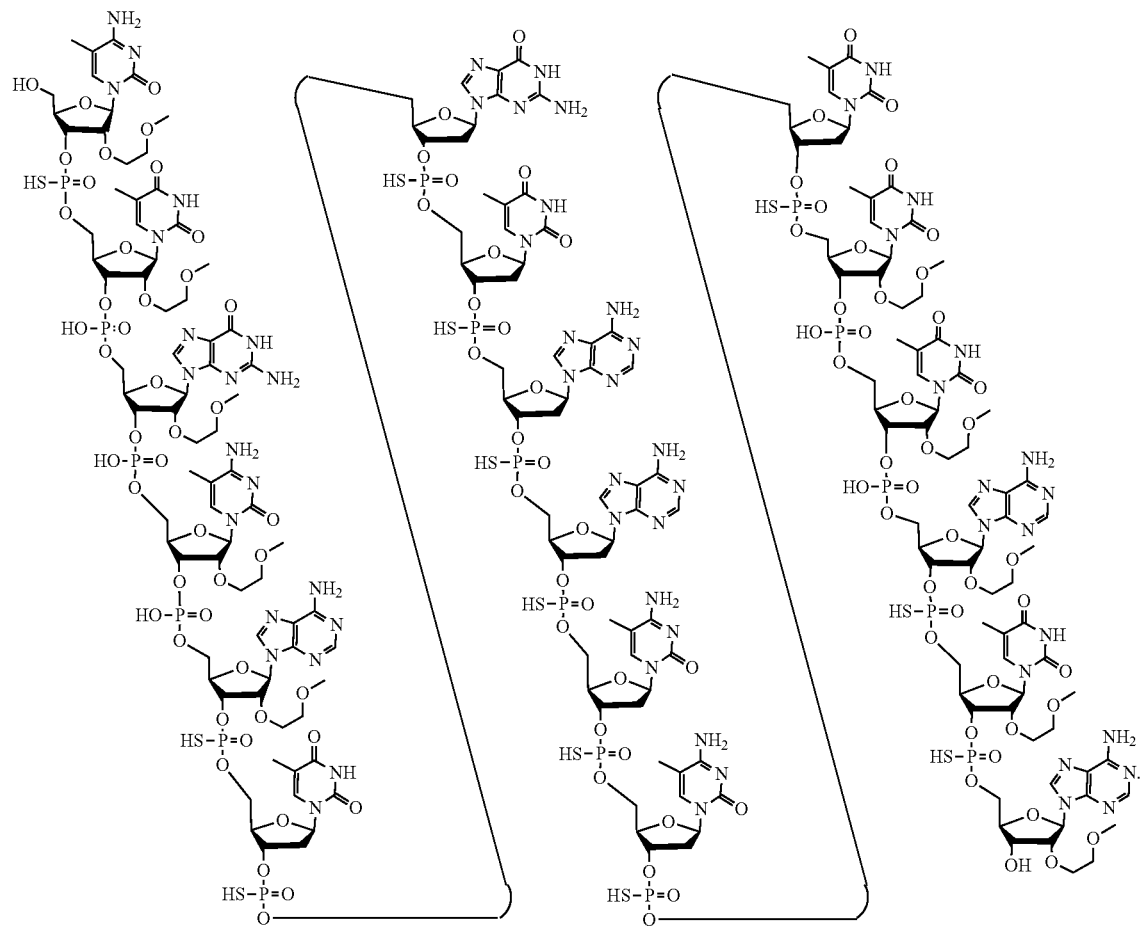

In certain embodiments, the sodium salt of Compound No. 1348937 is represented by the following chemical structure:

Structure 12 The sodium salt of Compound No. 1348937

(SEQ ID NO: 2534)

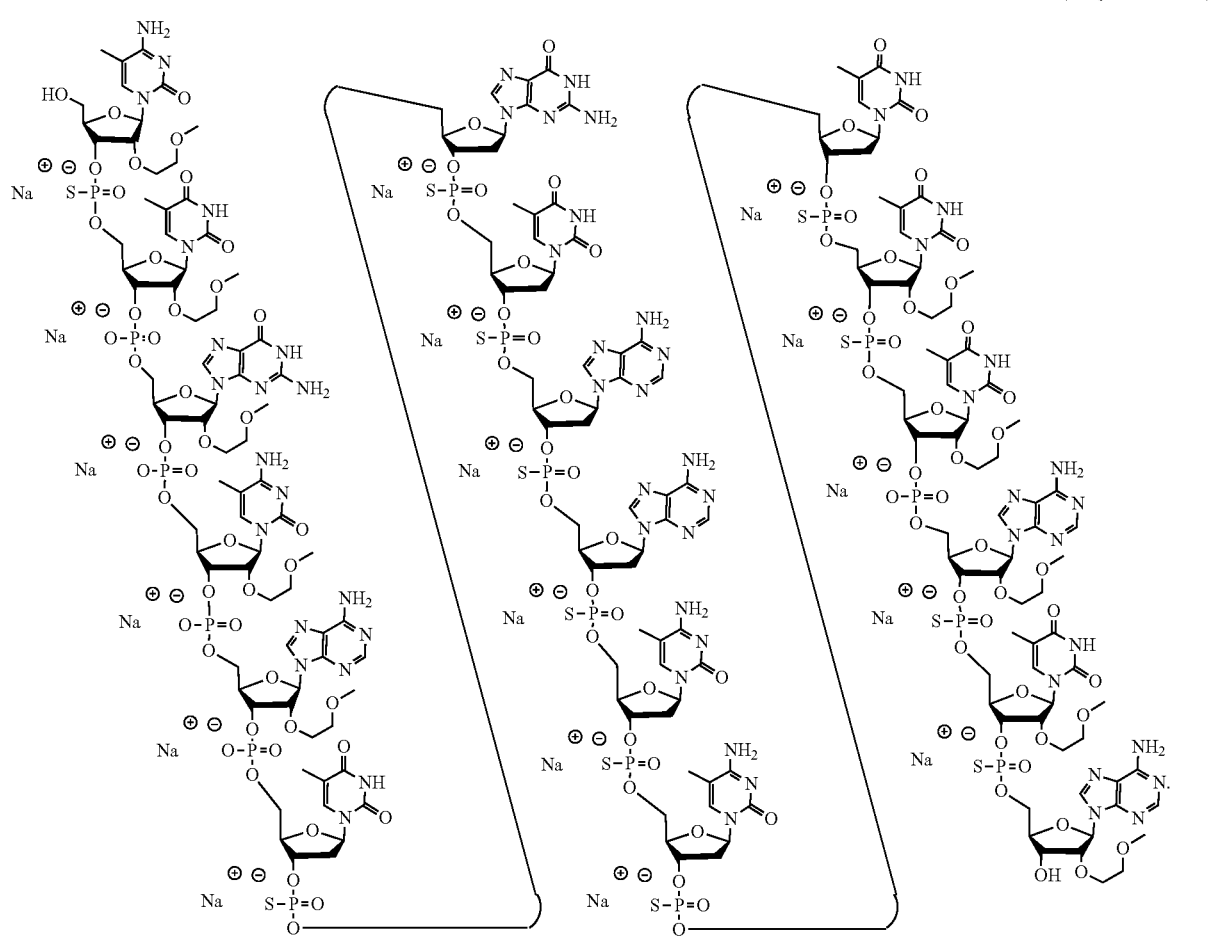

VIII. Certain Hotspot Regions

In certain embodiments, nucleobases in the ranges specified below comprise a hotspot region of SCN2A nucleic acid. In certain embodiments, modified oligonucleotides that are complementary to an equal length portion within a hotspot region of SCN2A nucleic acid achieve an average of 69.9% or greater reduction of SCN2A RNA in vitro in the standard in vitro assay. In certain embodiments, modified oligonucleotides that are complementary to an equal length portion within a hotspot region of SCN2A nucleic acid achieve an average of 59% or greater reduction of SCN2A RNA in vivo in the standard in vivo assay.

1. Nucleobases 2306-2367 of SEQ ID NO: 1 or 199863-199905 of SEQ ID No: 2

In certain embodiments, nucleobases 2306-2367 of SEQ ID NO: 1 or 199863-199905 of SEQ ID NO: 2 comprise a hotspot region. In certain embodiments, modified oligonucleotides are complementary to an equal length portion within nucleobases 2306-2367 of SEQ ID NO: 1 or 199863-199905 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers.

In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeceedddddddddceeee, eeeeeedddddddddeeee, eeeedddddddddeeeee, eceedddddddeceeee, eeeeeeddddddddeee, or eeeeedddddddceeee; wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, modified oligonucleotides do not compose a bicyclic sugar moiety. In certain embodiments, modified oligonucleotides do not comprise more than one, two, three, four, five, six, seven, eight, or nine bicyclic sugar moieties. In certain embodiments, modified oligonucleotides comprise one or two wing segments that comprise a nucleoside that is no a bicyclic nucleoside. In certain embodiments, modified oligonucleotides do not comprise a LNA sugar moiety. In certain embodiments, modified oligonucleotides do not comprise more than one, two, three, four, five, six, seven, eight, or nine LNA sugar moieties. In certain embodiments, modified oligonucleotides comprise one or two wing segments that comprise a nucleoside that is not a LNA nucleoside.

In certain embodiments, the internucleoside linkages of the modified oligonucleotides art, phosphorothioate internucleoside linkages and phosphodiester internucleoside linkages. In certain embodiments, the phosphodiester ("o") and phosphorothioate ("s") internucleoside linkages are arranged in order from 5' to 3'. In certain embodiments, the modified nucleotides have an internucleoside linkage motif of (from 5' to 3') of soooossssssssssooss, sooooossssssssssoss, sooossssssssssooss, soosssssssssooss, sooooossssssssssoss, or sooossssssssssooss wherein each "s" represents a phosphorothioate internucleoside linkage and each "o" represents a phosphodiester internucleoside linkage.

The nucleobase sequences of SEQ ID NOs: 336, 488, 2021, 2097, 2174, 2250, 2326, 2403, 2499, 2500, 2501, 2502, and 2526 are complementary to an equal length portion within nucleobases 2306-2367 of SEQ ID NO: 1 or 199863-199905 of SEQ ID NO: 2.

The nucleobase sequence of Compound IDs: 909979, 1248427, 1248428, 1248429, 1248430, 1248431, 1248432, 0.1248433, 1348279, 1348282, 1348286, 1348297, 0.1348328, 1348343, 1348358, 1348360, 1348361, 1348362, 1348364, 0.1348365, 1348366, 1348367, 1348378, and 1348380 are complementary to an equal length portion within nucleobases 2306-2367 of SEQ ID NO: 1 or 199863-199905 of SEQ ID NO: 2.

In certain embodiments, modified oligonucleotides complementary to an equal length portion within nucleobases 2306-2367 of SEQ ID NO: 1 or 199863-199905 of SEQ ID NO: 2 achieve at least 53% reduction of SCN2A RNA in vitro in the standard in vitro assay. In certain embodiments, modified oligonucleotides complementary to an equal length portion within nucleobases 2306-2367 of SEQ ID NO: 1 or 199863-199905 of SEQ ID NO: 2 achieve an average of 69.9% reduction of SCN2A RNA in vitro in the standard in vitro assay. In certain embodiments, modified oligonucleotides complementary to an equal length portion within nucleobases 2306-2367 of SEQ ID NO: 1 or 199863-199905 of SEQ ID NO: 2 achieve an average of 77.1% reduction of SCN2A RNA in vivo in the standard in vivo assay. In certain embodiments, modified oligonucleotides complementary to an equal length portion within nucleobases 2306-2367 of SEQ ID NO: 1 or 199861-199905 of SEQ ID NO: 2 achieve an average of 63.2% % reduction of SCN2A RNA in vivo in the standard in vivo assay.

2. Nucleobases 3499-3557 of SEQ ID NO: 1 or 227493-227551 of SEQ ID NO: 2

In certain embodiments, nucleobases 3499-3557 of SEQ ID NO: 1 or 227493-227551 of SEQ ID NO: 2 comprise a hotspot region. In certain embodiments, modified oligonucleotides are complementary to an equal length portion within nucleobases 3499-3557 of SEQ ID NO: 1 or 227493-227551 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers.

In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeedddddddddeeeee, eeeeeedddddddddeeee, eeeedddddddddeeeeee, eeeedddddddddeeeeee, eeeeedddddddeeee, or eeeeedddddddeeeee; wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the T-substituted nucleoside is at position 2 of the gap (5' to 3').

In certain embodiments, modified oligonucleotides do not comprise a bicyclic sugar moiety. In certain embodiments, modified oligonucleotides do not comprise more than one, two, three, four, five, six, seven, eight, or nine bicyclic sugar moieties. In certain embodiments, modified oligonucleotides comprise one or two wing segments that comprise a nucleoside that is not a bicyclic nucleoside. In certain embodiments, modified oligonucleotides do not comprise a LNA sugar moiety. In certain embodiments, modified oligonucleotides do not comprise more than one, two, three, four, five, six, seven, eight, or nine LNA sugar moieties. In certain embodiments, modified oligonucleotides comprise one or two wing segments that comprise a nucleoside that is not a LNA nucleoside.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3'. In certain embodiments, the modified nucleotides have an internucleoside linkage motif of (from 5' to 3') of soooosssssssssooss, sooooosssssssss-soss, sooosssssssssoooss, sooossssssssssoooss, sooooossssssssssoss, or sooossssssssssooss wherein each "s" represents a phosphorothioate internucleoside linkage and each "o" represents a phosphodiester internucleoside linkage.

The nucleobase sequences of SEQ ID NOs: 181, 259, 643, 720, 796, 2504, 2505, 2506, 2507, 2508, 2509, 2510, 2511, 2512, 2513, 2514, and 2521 are complementary to an equal length portion within nucleobases 3499-3557 of SEQ ID NO: 1 or 227493-227551 of SEQ ID NO: 2.

The nucleobase sequence of Compound Ds: 909989, 909990, 1248487, 1248488, 1248489, 1348289, 1348290, 1348291, 1348292, 1348295, 1348298, 1348302, 1348303, 1348304, 1348306, 1348307, 1348369, 1348370, 1348371, 1348373, 1348374, 1348375, 1348376, 1348377, 1348381, 1348382, 1348383, 1348384, 1348385, 1348386, 1348387, 1348405, 1348411, 1348423, 1348439, 1348440, 1348441, 1348442, 1148443, 1348444, 1348446, 1348417, and 1348456 are complementary to an equal length portion within nucleobases 3499-3557 of SEQ ID NO: 1 or 227493-227551 of SEQ ID NO: 2.

In certain embodiments, modified oligonucleotides complementary to an equal length portion within nucleobases 3499-3557 of SEQ ID NO: 1 or 227493-227551 of SEQ ID NO: 2 achieve at least 75% reduction of SCN2A RNA in vitro in the standard in vitro assay. In certain embodiments, modified oligonucleotides complementary to an equal length portion within nucleobases 3499-3557 of SEQ ID NO: 1 or 227493-227551 of SEQ ID NO: 2 achieve an average of 81.6% reduction of SCN2A RNA in vitro in the standard in vitro assay. In certain embodiments, modified oligonucleotides complementary to an equal length portion within nucleobases 3499-3557 of SEQ ID NO: 1 or 227493-227551 of SEQ ID NO: 2 achieve an average of 76.6% reduction of SCN2A RNA in vino ire the standard in vivo assay. In certain embodiments, modified oligonucleotides complementary to an equal length portion within nucleobases 3499-3557 of SEQ ID NO: 1 or 227493-227551 of SEQ ID NO: 2 achieve an average of 67.2% reduction of SCN2A RNA in vivo in the standard in vivo assay.

3. Nucleobases 243124-2432114 of SEQ ID NO: 2 in certain embodiments, nucleobases 243124-243204 of SEQ ID NO: 2 comprise a hotspot region. In certain embodiments, modified oligonucleotides are complementary to an equal length portion within nucleobases 243124-243204 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers.

In certain embodiments, the gapmers are 5-105 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeedddddddddeeeee, eeeeeedddddddddeeee, eeeedddddddddeeeee, eeeedddddddddeeeeee, eeeeeedddddddddeeee, or eeeeedddddddddeeeee; wherein 'd' represents a 2'-β-D-deoxyribosyl sugar moiety, and 'e' represents a 2'-MOE sugar moiety. In certain embodiments, the gapmers comprise a 2'-substituted nucleoside iii the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, modified oligonucleotides do not comprise a bicyclic sugar moiety. In certain embodiments, modified oligonucleotides do not comprise more than one, two, three, four, five, six, seven, eight, or nine bicyclic sugar moieties. In certain embodiments, modified oligonucleotides comprise one or two wing segments that comprise a nucleoside that is not a bicyclic nucleoside. In certain embodiments, modified oligonucleotides do lot comprise a LNA sugar moiety. In certain embodiments, modified oligonucleotides do not comprise more than one, two, ChM, fora, five, six, seven, eight, or nine LNA sugar moieties. In certain embodiments, modified oligonucleotides comprise one or two wing segments that comprise a nucleoside that is not a LNA nucleoside.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5 to 3'. In certain embodiments, the modified nucleotides have an internucleoside linkage motif of (from 5' to 3') of soooosssssssssssooss, soooooossssssssss-soss, soooossssssssooss, sooossssssssoooss, soooosssssssssoss, or soooossssssssooss wherein each "s" represents a phosphorothioate internucleoside linkage and each "o" represents a phosphodiester internucleoside linkage.

The nucleobase sequences of SEQ ID NOs: 491, 567, 644, 721, 797, 2177, 2253, 2315, 2329, 2406, and 2527 are complementary to an equal length portion within nucleobases 243124-243204 of SEQ ID NO: 2.

The nucleobase sequence of Compound IDs: 1248507, 1248508, 1248509, 1248510, 1248511, 1248512, 1248513, 1248514, 1248515, 1250138, 1348299, 1348379, 1348388, and 1348397 are complementary to an equal length portion within nucleobases 243124-243204 of SEQ ID NO: 2.

In certain embodiments, modified oligonucleotides complementary to an equal length portion within nucleobases 243124-243204 of SEQ ID NO: 2 achieve at least 51% reduction of SCN2A RNA in vitro in the standard in vitro assay. In certain embodiments, modified oligonucleotides complementary to an equal length portion within nucleobases 243124-243204 of SEQ ID NO: 2 achieve an average of 71.4% reduction of SCN2A RNA in vitro in the standard in vitro assay. In certain embodiments, modified oligonucleotides complementary to an equal length portion within nucleobases 243124-243204 of SEQ ID NO: 2 achieve an average of 61.3% reduction of SCN2A RNA in vivo in the standard in vivo assay. In certain embodiments, modified oligonucleotides complementary to an equal length portion within nucleobases 243:124-243204 of SEQ ID NO: 2 achieve an average of 61.5% reduction of SCN2A RNA in vivo in the standard in vivo assay.

4. Nucleobases 243917-244073 of SEQ ID NO: 2

In certain embodiments, nucleobases 243917-244073 of SEQ ID NO: 2 comprise a hotspot region. In certain embodiments, modified oligonucleotides are complementary to an equal length portion within nucleobases 243917-244073 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers.

In certain embodiments, the gapmers are 5-10-5 MOE gapmers. In certain embodiments, the gapmers are 6-10-4 MOE miners. In certain embodiments, the gapmers are 4-10-6 MOE gapmers. In certain embodiments, the gapmers are 4-8-6 MOE gapmers. In certain embodiments, the gapmers are 6-8-4 MOE gapmers. In certain embodiments, the gapmers are 5-8-5 MOE gapmers. In certain embodiments, the gapmers have the sugar motif in order from 5' to 3': eeeeeedddddddddeeeee, eeeeeedddddddddeeee, eeeedddddddddeeeee, eeeedddddddddeeeeee, eeeeeedddddddddeeee, or eeeeedddddddddeeeee; wherein 'd' represents a 2'-β-D-deoxyribosyl sugar moiety, and 'e' represents a 2'MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, modified oligonucleotides do not comprise a bicyclic sugar moiety. In certain embodiments, modified oligonucleotides do not comprise more than one, two, three, four, live, six, seven, eight, or nine bicyclic sugar moieties. In certain embodiments, modified oligonucleotides comprise one or two wing segments that comprise a nucleoside that is not a bicyclic nucleoside. In certain embodiments, modified oligonucleotides do not comprise a LNA sugar moiety. In certain embodiments, modified oligonucleotides do not comprise more than one, two, three, four, five, six, seven, eight, or nine LNA sugar moieties. In certain embodiments, modified oligonucleotides comprise one or two wing segments that comprise a nucleoside that is not a LNA nucleoside.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3'. In certain embodiments, the modified nucleotides have an internucleoside linkage motif of (from 5 to 3) of soooosssssssssooss, soooooosssssssss-soss, sooosssssssssoooss, soosssssssssoooss, sooooossssssssoss, or sooosssssssssooss wherein each "s" represents a phosphorothioate internucleoside linkage and each "o" represents a phosphodiester internucleoside linkage.

The nucleobase sequences of SEQ ID NOs: 1090, 1166, 2484, 2485, 2487, 2493, 2496, 2497, 2498, 2533, 2534, 2535, and 2537 are complementary to an equal length portion within nucleobases 243917-244073 of SEQ ID NO: 2.

The nucleobase sequence of Compound IDs: 1250148, 1250149, 1348250, 1348251, 1348253, 1348259, 1348265, 1348266, 1348267, 1348331, 1348332, 1348333, 1348338, 1348342, 1348344, 1348345, 1348347, 1348419, 1348420, 1348421, 1348427, 1348428, 1348435, 1348436, 1348437, 1348920, 1348922, 1348923, 1348925, 1348927, 1348928, 1348929, 1348931, 1348934, 1348935, 1348937, and 1348938 are complementary to an equal length portion within nucleobases 243917-244073 of SEQ ID NO: 2.

In certain embodiments, modified oligonucleotides complementary to an equal length portion within nucleobases 243917-244073 of SEQ ID NO: 2 achieve at least 80% reduction of SCN2A RNA in vitro in the standard in vitro assay. In certain embodiments, modified oligonucleotides complementary to an curial length portion within nucleobases 243917-244073 of SEQ ID NO: 2 achieve an average of 80.5% reduction of SCN2A RNA in vitro in the standard in vitro assay. In certain embodiments, modified oligonucleotides complementary to an equal length portion within nucleobases 243917-244073 of SEQ ID NO: 2 achieve an average of 67.7%, reduction of SCN2A RNA in vivo in the standard in vivo assay. In certain embodiments, modified oligonucleotides complementary to an equal length portion within nucleobases 243917-244073 of SEQ ID NO: 2 achieve an average of 62.1% reduction of SCN2A RNA in vivo in the standard in vivo assay.

5. Nucleobases 4389-4487 of SEQ ID NO: 1 or 247823447921 of SEO ID NO: 2

In certain embodiments, nucleobases 43894487 of SEQ ID NO: 1 or 247823447921 of SEQ ID NO: 2 comprise a hotspot region. In certain embodiments, modified oligonucleotides are complementary to an equal length portion within nucleobases 4389-4487 of SEQ ID NO: 1 or 247823447921 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers.

In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-84 MOE gapmers. In certain embodiments, the gapmers are 5-8-5 MOE gapmers. In certain embodiments, the gapmers have the sugar motif in order from 5' to 3': eeeedddddddddeeee, eeeeedddddddddeee, eeeedddddddddeeeee, eeeedddddddddeeeeee, eeeeedddddddeee, or eeeeedddddddeeeee; wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, modified oligonucleotides do not comprise a bicyclic sugar moiety. In certain embodiments, modified oligonucleotides do not comprise more than one, two, three, four, five, six, seven, eight, or nine bicyclic sugar moieties. In certain embodiments, modified oligonucleotides comprise one or two wing segments that comprise a nucleoside that is not a bicyclic nucleoside. In certain embodiments, modified oligonucleotides do not comprise a LNA sugar moiety. In certain embodiments, modified oligonucleotides do not comprise more than one, two, three, four, five, six, seven, eight or nine LNA sugar moieties. In certain embodiments, modified oligonucleotides comprise one or two wing segments that comprise a nucleoside that is not a LNA nucleoside.

In certain embodiments, the internucleoside linkages of the modified oligonucleotides are phosphorothioate internucleoside linkages and phosphodiester internucleoside linkages. In certain embodiments, the phosphodiester ("0") and phosphorothioate ("s") internucleoside linkages are arranged in order from 5' to 3'. In certain embodiments, the modified nucleotides have an internucleoside linkage motif of (from 5' to 3') of soooossssssssssooss, soooooossssssssss-soss, sooosssssssssoooss, soosssssssssoooss, sooooosssssssssoss, or sooosssssssssooss wherein each "s" represents a phosphorothioate internucleoside linkage and each "o" represents a phosphodiester internucleoside linkage.

The nucleobase sequences of SEQ ID NOs: 29, 30, 107, 108, 185, 186, 263, 254, 341, 342, 419, 420, 1796, 1871, 1948, 2025, 2101, 2178, 2254, 2330, 2503, 2517, and 2522 are complementary to an equal length portion within nucleobases 4389-4487 of SEQ ID NO: 1 or 247823-247921 of SEQ ID NO: 2.

The nucleobase sequence of Compound IDs: 910009, 910010, 910011, 910012, 910013, 910014, 910015, 910016, 910017, 910018, 910019, 910020, 1248528, 1248529, 1248530, 1248531, 1248532, 1248533, 1248534, 1248535, 1348269, 1348270, 1348271, 1348275, 1348277, 1348348, 1348353, 1348355, 1348356, 134896, and 1348450 are complementary to an equal length portion within nucleobases 4389-4487 of SEQ ID NO: 1 or 247823-247921 of SEQ ID NO: 2.

In certain embodiments, modified oligonucleotides complementary to an equal length portion within nucleobases 4389-4487 of SEQ ID NO: 1 or 247823-247921 of SEQ ID NO: 2 achieve at least 27% reduction of SCN2A RNA in vitro in the standard in vitro assay. In certain embodiments, modified oligonucleotides complementary to an equal length portion within nucleobases 43894487 of SEQ ID NO: 1 or 247823-247921 of SEQ ID NO: 2 achieve an average of 71.1% reduction of SCN2A RNA in vitro in the standard in vitro assay. In certain embodiments, modified oligonucleotides complementary to an equal length portion within nucleobases 4389-4487 of SEQ ID NO: 1 or 247823-247921 of SEQ ID NO: 2 achieve an average of 63.4% reduction of SCN2A RNA in vivo in the standard in vivo assay. In certain embodiments, modified oligonucleotides complementary to an equal length portion within nucleobases 4389-4487 of SEQ ID NO: 1 or 247823-247921 of SEQ ID NO: 2 achieve an average of 59.1% reduction of SCN2A RNA in vivo in the standard in vivo assay.

6. Nucleobases 4774-4809 of SEQ ID NO: 1 or 254142-254177 of SEQ ID NO: 2

In certain embodiments, nucleobases 4774-4809 of SEQ ID NO: 1 or 254142-254177 of SEQ ID NO: 2 comprise a hotspot region. In certain embodiments, modified oligonucleotides are complementary to an equal length portion within nucleobases 4774-4809 of SEQ ID NO: 1 or 254142-254177 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 17-19 or 21-30 linked nucleosides. In certain embodiments, modified oligonucleotides are gapmers.

In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-84 MOE gapmers. In certain embodiments, the gapmers are 5-8-5 MOE gapmers. In certain embodiments, the gapmers have the sugar motif in order from 5' to 3': eeeeedddddddddeeeee, eeeeeedddddddddeeee, eeeedddddddddeeeeee, eeeedddddddeeeeee, eeeeeedddddddddeeee, or eeeeedddddddddeeeee; wherein 'd' represents a 2'-β-D-deoxyribosyl sugar moiety, and 'e' represents a 2'-1' MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, modified oligonucleotides do not comprise a bicyclic sugar moiety. In certain embodiments, modified oligonucleotides do not comprise more than one, two, three, four, five, six, seven, eight, or nine bicyclic sugar moieties. In certain embodiments, modified oligonucleotides comprise one or two wing segments that comprise a nucleoside that is not a bicyclic nucleoside. In certain embodiments, modified oligonucleotides do not comprise a LNA sugar moiety. In certain embodiments, modified oligonucleotides do not comprise MOM than one, two, three, four, five, six, seven, eight or nine LNA sugar moieties. In certain embodiments, modified oligonucleotides comprise one or two wing segments that comprise a nucleoside that is not a LNA nucleoside.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3'. In certain embodiments, the modified nucleotides have an internucleoside linkage motif of (from 5' to 3') of soooosssssssssssooss, soooooossssssssss-soss, sooosssssssssoooss, sooosssssssssoooss, soooosssssssssoss, or sooosssssssssooss wherein each "s" represents a phosphorothioate internucleoside linkage and each "o" represents a phosphodiester internucleoside linkage.

The nucleobase sequences of SEQ ID NOs: 1016, 1093, 1104, 1169, 1246, 1323, 1400, 1477, 1554, 1708, 1785, 1860, 1937, 2014, 1631, 2090, and 2539 are complementary to an equal length portion within nucleobases 4774-4809 of SEQ ID NO: 1 or 254142-254177 of SEQ ID NO: 2.

The nucleobase sequence of Compound IDs: 1248544, 1250225, 1250226, 1250227, 1250228, 1250229, 1250230, 1250231, 1250232, 1250233, 1250234, 1250235, 1250236, 1250237, 1250238, 1250239, 1348936, and 1348939 are complementary to an equal length portion within nucleobases 4774-4809 of SEQ ID NO: 1 or 254142-254177 of SEQ ID NO: 2.

In certain embodiments, modified oligonucleotides complementary to an equal length portion within nucleobases 4774-4809 of SEQ ID NO: 1 or 254142-254177 of SEQ ID NO: 2 achieve at least 51% reduction of SCN2A RNA in vitro in the standard in vitro assay. In certain embodiments, modified oligonucleotides complementary to an equal length portion within nucleobases 4774-4809 of SEQ TD NO: 1 or 254142-254177 of SEQ ID NO: 2 achieve an average of 89% reduction of SCN2A RNA in vitro in the standard in vitro assay. In certain embodiments, modified oligonucleotides complementary to an equal length portion within nucleobases 4774-4809 of SEQ ID NO: 1 or 254142-254177 of SEQ ID NO: 2 achieve an average of 74.8% reduction of SCN2A RNA in vivo in the standard in vivo assay. In certain embodiments, modified oligonucleotides complementary to an equal length portion within nucleobases 4774-4809 of SEQ ID NO: 1 or 254142-254177 of SEQ ID NO: 2 achieve an average of 67.8% % reduction of SCN2A RNA in vivo in the standard in vivo assay.

7. Additional Hotspot Regions

In certain embodiments, the ranges described in the table below comprise hotspot regions. Each hotspot region begins with the nucleobase of SEQ ID NO:2 identified in the "Start Site SEQ ID NO: 2" column and ends with the nucleobase of SEQ ID NO: 2 identified in the "Stop Site SEQ ID NO: 2" column. In certain embodiments, modified oligonucleotides are complementary to an equal length portion within any of the hotspot regions 1-17, as defined in the table below. In certain embodiments, modified oligonucleotides are 20 nucleobases in length. In certain embodiments, modified oligonucleotides are 18 nucleobases in length. In certain embodiments, modified oligonucleotides are 16, 17, 18, 19, 20, 21, or 22 nucleobases in length. In certain embodiments, modified oligonucleotides consist of 1749 or 21-30 linked nucleosides. In certain embodiments, modified oligonucleotides are gapmers.

In certain embodiments, the gapmers are 5-10-5 MOE gapmers. In certain embodiments, the gapmers are 6-10-4 MOE gapmers. In certain embodiments, the gapmers are 4-10-6 MOE gapmers. In certain embodiments, the gapmers are 4-8-6 MOE gapmers. In certain embodiments, the gapmers are 6-8-4 MOE miners. In certain embodiments, the gapmers are 5-8.5 MOE gapmers. In certain embodiments, the gapmers have the sugar motif in order from 5' to eeeeedddddddddeeeee, eeeeeedddddddddeeee, eeeedddddddddeeeeee, eeeedddddddeeeeee, eeeeeedddddddddeeee, or eeeeedddddddddeeeee; wherein 'd' represents a 2'-β-D-deoxyribosyl sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, modified oligonucleotides do not comprise a bicycle sugar moiety. In certain embodiments, modified oligonucleotides do not comprise more than one, two, three, four, five, six, seven, eight, or nine bicyclic sugar moieties. In certain embodiments, modified oligonucleotides comprise one or two wing segments that comprise a nucleoside that is not a bicyclic nucleoside. In certain embodiments, modified oligonucleotides do not comprise a LNA sugar moiety. In certain embodiments, modified oligonucleotides do not comprise more than one, two, three, four, five, six, seven, eight, or nine LNA sugar moieties. In certain embodiments, modified oligonucleotides comprise one or two wing segments that comprise a nucleoside that is not a LNA nucleoside.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3'. In certain embodiments, the modified nucleotides have an internucleoside linkage motif of (from 5' to 3') of soooosssssssssooss, sooooossssssssss-soss, sooosssssssssoooss, soossssssssoooss, sooooossssssssoss, or sooossssssssooss wherein each "s" represents a phosphorothioate internucleoside linkage and each "o" represents a phosphodiester internucleoside linkage.

The nucleobase sequence of compounds listed in the "Compound IDs in range" column in the table below are complementary to SEQ ID NO: 2 within the specified hotspot region. The nucleobase sequence of the oligonucleotides listed in the "SEQ ID NOs in range" column in the table below are complementary to the target sequence, SEQ ID NO: 2, within the specified hotspot region.

In certain embodiments, modified oligonucleotides complementary to nucleobases within the hotspot region achieve at least "Min. % Red. in vitro" (minimum % reduction, relative to untreated control cells) of SCN2A RNA in vitro in the standard in vitro assay, as indicated in the table below. In certain embodiments, modified oligonucleotides complementary to nucleobases within the hotspot region achieve an average of "Avg. % Red. in vitro" (average % reduction, relative to untreated control cells) of SCN2A RNA in vitro in the standard in vitro assay, as indicated in the table below. In certain embodiments, modified oligonucleotides complementary to nucleobases within the hotspot region achieve a maximum of "Max. % Red. in vitro" (maximum % reduction, relative to untreated control cells) of SCN2A RNA in vitro in the standard in vitro assay, as indicated in the table below. In certain embodiments, modified oligonucleotides complementary to nucleobases within the hotspot region achieve an average of "Avg. % Red. in vivo Cortex" (average % reduction, relative to PBS-treated animals) of SCN2A RNA in vivo in the standard in vivo assay in conical tissue, as indicated in the table below. In certain embodiments, modified oligonucleotides complementary to nucleobases within the hotspot region achieve an average of "Avg. % Red. in vivo Spinal" (average % reduction, relative to PBS-treated animals) of SCN2A RNA in vivo in the standard in vivo assay in spinal cord tissue, as indicated in the table below. "n.d." indicates that no in vivo data is available for compounds within that range. In other cases, average reduction in vivo includes a subset of the compounds in any given hotspot, as not all compounds were tested in vivo.

TABLE 1

SCN2A Hotspots

| Hotspot ID | Start Site SEQ ID NO: 2 | Stop Site SEQ ID NO: 2 | Min % Red. in vitro | Max % Red. in vitro | Avg % Red. in vitro | Avg % Red. in vivo Cortex | Avg % Red. in vivo Spinal | Compound IDs in range | SEQ ID NOs in range |
|---|---|---|---|---|---|---|---|---|---|
| 1 | 199863 | 199905 | 53 | 83 | 69.9 | 77.1 | 63.2 | 909979, 1248427, 1248428, 1248429, 1248430, 1248431, 1248432, 1248433, 1348279, 1348282, 1348286, 1348297, 1348328, 1348343, 1348358, 1348360, 1348361, 1348362, 1348364, 1348365, 1348366, 1348367, 1348378, and 1348380 | 336, 488, 2021, 2097, 2174, 2250, 2326, 2403, 2499, 2500, 2501, 2502, and 2526 |
| 2 | 227493 | 227551 | 75 | 88 | 81.6 | 76.6 | 67.2 | 909989, 909990, 1248487, 1248488, 1248489, 1348289, 1348290, 1348291, 1348292, 1348295, 1348298, 1348302, 1348303, 1348304, 1348306, 1348307, 1348369, 1348370, 1348371, 1348373, 1348374, 1348375, 1348376, 1348377, 1348381, 1348382, 1348383, 1348384, 1348385, 1348386, 1348387, 1348405, 1348411, 1348423, | 181, 259, 643, 720, 796, 2504, 2505, 2506, 2507, 2508, 2509, 2510, 2511, 2512, 2513, 2514, and 2521 |

TABLE 1-continued

SCN2A Hotspots

| Hotspot ID | Start Site SEQ ID NO: 2 | Stop Site SEQ ID NO: 2 | Min % Red. in vitro | Max % Red. in vitro | Avg % Red. in vitro | Avg % Red. in vivo Cortex | Avg % Red. in vivo Spinal | Compound IDs in range | SEQ ID NOs in range |
|---|---|---|---|---|---|---|---|---|---|
| | | | | | | | | 1348439, 1348440, 1348441, 1348442, 1348443, 1348444, 1348446, 1348447, and 1348456 | |
| 3 | 243124 | 243204 | 51 | 90 | 71.4 | 61.3 | 61.5 | 1248507, 1248508, 1248509, 1248510, 1248511, 1248512, 1248513, 1248514, 1248515, 1250138, 1348299, 1348379, 1348388, and 1348397 | 491, 567, 644, 721, 797, 2177, 2253, 2315, 2329, 2406, and 2527 |
| 4 | 243917 | 244073 | 80 | 81 | 80.5 | 67.7 | 62.1 | 1250148, 1250149, 1348250, 1348251, 1348253, 1348259, 1348265, 1348266, 1348267, 1348331, 1348332, 1348333, 1348338, 1348342, 1348344, 1348345, 1348347, 1348419, 1348420, 1348421, 1348427, 1348428, 1348435, 1348436, 1348437, 1348920, 1348922, 1348923, 1348925, 1348927, 1348928, 1348929, 1348931, 1348934, 1348935, 1348937, and 1348938 | 1090, 1166, 2484, 2485, 2487, 2493, 2496, 2497, 2498, 2533, 2534, 2535, and 2537 |
| 5 | 247823 | 247921 | 27 | 92 | 71.1 | 63.4 | 59.1 | 910009, 910010, 910011, 910012, 910013, 910014, 910015, 910016, 910017, 910018, 910019, 910020, 1248528, 1248529, 1248530, 1248531, 1248532, 1248533, 1248534, 1248535, 1348269, 1348270, 1348271, 1348275, 1348277, 1348348, 1348353, 1348355, 1348356, 1348396, and 1348450 | 29, 30, 107, 108, 185, 186, 263, 264, 341, 342, 419, 420, 1796, 1871, 1948, 2025, 2101, 2178, 2254, 2330, 2503, 2517, and 2522 |
| 6 | 254142 | 254177 | 51 | 89 | 71.7 | 74.8 | 67.8 | 1248544, 1250225, 1250226, 1250227, 1250228, 1250229, 1250230, 1250231, 1250232, 1250233, 1250234, 1250235, 1250236, 1250237, 1250238, 1250239, 1348936, and 1348939 | 1016, 1093, 1104, 1169, 1246, 1323, 1400, 1477, 1554, 1708, 1785, 1860, 1937, 2014, 1631, 2090, and 2539 |
| 7 | 168911 | 168945 | 71 | 93 | 81.2 | n.d. | n.d. | 909945, 909946, 1248352, 1248353, 1248354, 1248355, 1248356, 1248357, 1248358, 1248359, and 1248360. | 18, 96, 485, 561, 638, 715, 791, 868, 2247, 2323, and 2400 |

TABLE 1-continued

| | | | | | | | Avg % | Avg % | | |
|---|---|---|---|---|---|---|---|---|---|---|
| | Start Site | Stop Site | Min % | Max % | Avg % | Red. in | Red. in | | SEQ ID |
| Hotspot | SEQ ID | SEQ ID | Red. in | Red. in | Red. in | vivo | vivo | Compound IDs | NOs in |
| ID | NO: 2 | NO: 2 | vitro | vitro | vitro | Cortex | Spinal | in range | range |

SCN2A Hotspots

| Hotspot ID | Start Site SEQ ID NO: 2 | Stop Site SEQ ID NO: 2 | Min % Red. in vitro | Max % Red. in vitro | Avg % Red. in vitro | Avg % Red. in vivo Cortex | Avg % Red. in vivo Spinal | Compound IDs in range | SEQ ID NOs in range |
|---|---|---|---|---|---|---|---|---|---|
| 8 | 170026 | 170061 | 65 | 84 | 82.3 | n.d. | n.d. | 909947, 1248366, 1248367, 1248368, 1248369, 1248370, 1248371, 1248372, 1248373, 1248374, and 1248375 | 174, 1328, 1405, 1482, 1559, 1636, 1713, 1790, 1865, 1942, and 2019 |
| 9 | 170174 | 170200 | 69 | 93 | 81.6 | n.d. | n.d. | 910246, 1249167, 1249168, 1249169, 1249170, 1249171, and 1249172 | 302, 1513, 1667, 1744, 1819, 1896, and 1973 |
| 10 | 176724 | 176751 | 75 | 94 | 86.7 | n.d. | n.d. | 910256, 910257, 1249294, 1249295, 1249296, 1249297, 1249298, and 1249299 | 148, 226, 1364, 1441, 1518, 1595, 1672, and 1749 |
| 11 | 180772 | 180801 | 67 | 93 | 78.6 | n.d. | n.d. | 910263, 1249423, 1249424, 1249425, 1249426, 1249427, 1249428, 1249429, and 1249430 | 227, 1292, 1369. 1446, 1523, 1600, 1677, 1754, and 1829 |
| 12 | 183519 | 183562 | 73 | 97 | 83.1 | n.d. | n.d. | 909954, 909955, 909956, 909957, 909958, 1248393, 1248394, 1248395, 1248396, 1248397, 1248398, 1248399, and 1248400 | 20, 98, 253, 332, 410, 1406, 1483, 1560, 1637, 1714, 1791, 1866, and 1943 |
| 13 | 183968 | 184016 | 60 | 95 | 77.1 | n.d. | n.d. | 910269, 1249480, 1249481, 1249482, 1249483, 1249484, 1249485, 1249486, 1249487, and 1249488 | 228, 1679, 1756, 1831, 1908, 1985, 2061, 2138, 2214, and 2290 |
| 14 | 188630 | 188668 | 68 | 86 | 77.1 | n.d. | n.d. | 909962, 909963, 1248419, 1248420, 1248421, 1248422, and 1248423 | 21, 411, 1407, 1484, 1561, 1638, and 1715 |
| 15 | 199912 | 199962 | 72 | 94 | 82.7 | n.d. | n.d. | 909980, 909981, 1248438, 1248439, 1248440, and 1248441 | 24, 414, 871, 948, 1025, and 1100 |
| 16 | 202877 | 202906 | 70 | 92 | 81.5 | n.d. | n.d. | 1249708, 1249709, 1249710, 1249711, 1249712, and 1249713 | 1226, 1303, 1380, 1457, 1534, and 1611 |
| 17 | 227419 | 227450 | 67 | 92 | 80.6 | n.d. | n.d. | 909985, 909986, 909987, 1248480, 1248481, 1248482, 1248483, 1248484, 1248485, and | 25, 337, 415, 490, 566, 2099, 2176, 2252, |

TABLE 1-continued

SCN2A Hotspots

| Hotspot ID | Start Site SEQ ID NO: 2 | Stop Site SEQ ID NO: 2 | Min % Red. in vitro | Max % Red. in vitro | Avg % Red. in vitro | Avg % Red. in vivo Cortex | Avg % Red. in vivo Spinal | Compound IDs in range | SEQ ID NOs in range |
|---|---|---|---|---|---|---|---|---|---|
| | | | | | | | | 1248486 | 2328, and 2405 |

IX. Certain Comparator Compounds

Comparator Compound No. 1506060 was selected as a comparator compound in the experiment described in Example 4 of the instant specification. Comparator. Compound No. 1506060, previously described in WO20201041348, incorporated herein by reference, is a 4-84 LNA gapmer with the sequence (from 5' to 3') TGGGTCTCTTQAGCTTT (SEQ ID NO: 2540), wherein the central gap segment consists of eight 2-β-D-deoxynucleosides, the 5' and 3' wing segments each consist of four LNA modified nucleosides, and each internucleoside linkage is a phosphorothioate internucleoside linkage.

In certain embodiments, compounds described herein are more tolerable relative to Comparator Compound No. 1506060.

For example, as described herein (see Example 4), Comparator Compound No. 1506060 had a 3-hour FOB of 6.00 in mice, whereas Compound Nos. 1348290, 1348331, and 1348347 each bad a 3-hour FOB of 0.00 in mice, and Compound Nos. 1148259, 1348289, and 1348937 each had a 3-hour FOB of 0 or 1.00 in mice. Therefore, certain compounds described herein are more tolerable than Comparator Compound No. 1506060 in this assay.

Nonlimiting Disclosure and Incorporation by Reference

Each of the literature and patent publications listed herein is incorporated by reference in its entirely.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is. In certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^m$CGAUCG," wherein $^m$C, indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, all cis- and trans-isomers and tautomeric forms of the compounds herein are also included unless otherwise indicated. Oligomeric compounds described herein include chorally pure or enriched mixtures as well as racemic mixtures. For example, oligomeric compounds having a plurality of phosphorothioate internucleoside linkages include such compounds in which chirality of the phosphorothioate internucleoside linkages is controlled or is random. Unless otherwise indicated, compounds described herein are intended to include corresponding salt forms.

The compounds described herein include variations in which one or more atoms are replaced with a non radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification

Example 1: Effect of 5-10-5 MOE Gapmer Modified Oligonucleotides on Human SCN2A RNA In Vitro, Single Dose Modified oligonucleotides complementary to human SCN2A nucleic acid were designed and tested for their single dose effects on SCN2A RNA in vitro. The modified oligonucleotides were tested in a series of experiments that had similar culture conditions.

The modified oligonucleotides in the tables below are 5-10-5 MOE gapmers with mixed PO/PS internucleoside linkages. The gapmers are 20 nucleosides in length, wherein the central gap segment consists of ten 2'-11-D-deoxynucleosides and the 5' and 3' wing segments each consists of live 2'-MOE modified nucleosides. The sugar motif for the gapmers is (from 5' to 3'): eeeeeddddddddddeeeee; wherein 'd' represents a 2'-β-D-deoxyribosyl sugar, and 'e' represents a 2'-MOE sugar moiety. The internucleoside linkage motif for the gapmers is (from 5' to 3'): soooosssssssssssooss; wherein each 'o' represents a phosphodiester internucleoside linkage and each 's' represents a phosphorothioate internucleoside linkage. Each cytosine residue is a 5-methyl cytosine.

"Start site" indicates the 0.5%-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the tables below is 100% complementary to either human SCN2A mRNA, designated herein as SEQ ID NO: 1 (GENBANK Accession No. NM_001040142.2) or the human SCN2A genomic sequence, designated herein as SEQ ID NO: 2 (GENBANK Accession No. NC_000002.12 truncated from nucleotides 165127001 to 1615395000), or to both. 'N/A' indicates that the modified oligonucleotide is not 100% complementary to that particular target nucleic acid sequence.

Cultured SH-SY5Y cells went treated with modified oligonucleotide at a concentration of 400) or 5000 nM using electroporation at a density of 20,006) cells per well. After a treatment period of approximately 24 hours, total RNA was isolated from the cells and SCN2A RNA levels were measured by quantitative real-time RTPCR. SCN2A RNA levels were measured by Human primer probe set RTS36041 (forward sequence CCTTGAACCTGAAGCCTGTT, designated herein as SEQ ID NO: 10; reverse sequence CGAACCAATTGTGCTCCACTA, designated herein as SEQ ID NO: 11; probe sequence TTCCACCAGAGTTTCCCTTGCCT, designated herein as SEQ ID NO: 12). SCN2A RNA levels were normalized to total RNA content as measured by RIBOGREEN®. Reduction of SCN2A RNA is presented in the tables below as percent SCN2A RNA amount relative to the amount in untreated control cells (% control). Each table represents results from an individual assay plate. The values marked with, an "†" indicate that the modified oligonucleotide is complementary to the amplicon region of the primer probe set. Additional assays may be used to measure the potency and efficacy of the modified oligonucleotides complementary to the amplicon region.

TABLE 2

Reduction of SCN2A RNA by 5-10-5 MOE gapmers with mixed PO/PS internucleoside linkages at 5000 nM concentration in SH-SY5Y cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | SCN2A RNA (% control) | SEQ ID NO |
|---|---|---|---|---|---|---|---|
| 909933 | N/A | N/A | 166831 | 166850 | GACATATGTCTGAAGCAGCC | 77 | 16 |
| 909939 | N/A | N/A | 167084 | 167103 | ATTGATAAGCTGGCACCAAG | 27 | 17 |
| 909945 | 374 | 393 | 168919 | 168938 | GTTTGGGTCTCTTAGCTTTC | 10 | 18 |
| 909951 | 1064 | 1083 | 183411 | 183430 | ACTGCAATCCTATTAGCGCA | 7 | 19 |
| 909957 | 1188 | 1207 | 183535 | 183554 | GTCCTATTGAAAGTAGTACC | 22 | 20 |
| 909963 | 1840 | 1859 | 188649 | 188668 | TTCCGATTTTCGGACTCTGT | 23 | 21 |
| 909969 | 2080 | 2099 | 196286 | 196305 | TCGGCTGTCATTGTCCTCAA | 17 | 22 |
| 909975 | 2095 | 2114 | 196301 | 196320 | GAACAGAGAGTCTCTTCGGC | 21 | 23 |
| 909981 | 2367 | 2386 | 199924 | 199943 | CTTTGCCTTGATGTAGGATC | 10 | 24 |
| 909987 | 3437 | 3456 | 227431 | 227450 | CTATGGTGGTATGGTTGGAA | 8 | 25 |
| 909993 | 3647 | 3666 | 227641 | 227660 | CCTCCATATCTGACTCGCTG | 26 | 26 |
| 909999 | 3723 | 3742 | 238188 | 238207 | TCTCCCTCGGCGGGAGCTCC | 45 | 27 |
| 910005† | 3804 | 3823 | 240222 | 240241 | CAACACTTGAACTTCCGTAC | 8 | 28 |
| 910010 | 4399 | 4418 | 247833 | 247852 | GACCACGCTTACATCAAACA | 24 | 29 |
| 910016 | 4423 | 4442 | 247857 | 247876 | AGCTTTGCACTCACTGTAGT | 28 | 30 |

TABLE 2-continued

Reduction of SCN2A RNA by 5-10-5 MOE gapmers with mixed PO/PS internucleoside linkages at 5000 nM concentration in SH-SY5Y cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | SCN2A RNA (% control) | SEQ ID NO |
|---|---|---|---|---|---|---|---|
| 910022 | 4587 | 4606 | 253592 | 253611 | TACTTGGGTTGTAATTCTAC | 13 | 31 |
| 910028 | 6030 | 6049 | 262558 | 262577 | TTTTGCTTCAAGAGGTAGCG | 61 | 32 |
| 910034 | 6196 | 6215 | 262724 | 262743 | GGTCACACTATCATACGAGG | 26 | 33 |
| 910040 | 6482 | 6501 | 263010 | 263029 | CCCATCGATACTATTTCTCC | 54 | 34 |
| 910046 | 6539 | 6558 | 263067 | 263086 | GTAGCCATTACGCCTCTGCT | 39 | 35 |
| 910052 | 6848 | 6867 | 263376 | 263395 | GAATTGCAGCATGCCTCCAT | 37 | 36 |
| 910057 | 7340 | 7359 | 263868 | 263887 | CTATGTCAACCTTACCAAGA | 39 | 37 |
| 910063 | 7687 | 7706 | 264215 | 264234 | GTTTGCTGCAACCTATTGCT | 37 | 38 |
| 910069 | 7994 | 8013 | 264522 | 264541 | CCTACACTGCATCCTAGTCC | 54 | 39 |
| 910075 | 8251 | 8270 | 264779 | 264798 | GTTCTAGTGCCATATGGGTC | 45 | 40 |
| 910081 | 8448 | 8467 | 264976 | 264995 | ACCGTTCTTTATGGTAACAG | 31 | 41 |
| 910087 | 8471 | 8490 | 264999 | 265018 | TTGGCTTGATTGTAATGTGG | 30 | 42 |
| 910093 | N/A | N/A | 112411 | 112430 | GGTACCCAATGTCTGTTAGA | 120 | 43 |
| 910099 | 17 | 36 | 112430 | 112449 | GTTCTGACAGTCATTCGATG | 81 | 44 |
| 910105 | N/A | N/A | 68142 | 68161 | CACGCCAGTCTTCAGCAGTT | 70 | 45 |
| 910111 | N/A | N/A | 67941 | 67960 | CACCTAAATCAGGGCAGTGC | 101 | 46 |
| 910117 | N/A | N/A | 67973 | 67992 | GCATTCCCGCTGCAGTAAG | 125 | 47 |
| 910123 | N/A | N/A | 81138 | 81157 | GCAGAACAGTAGTATTCCTC | 141 | 48 |
| 910129 | N/A | N/A | 4279 | 4298 | GGAGCTTGGTCTGTCAAATG | 39 | 49 |
| 910135 | N/A | N/A | 45144 45306 | 45163 45325 | TTAGTTAAGTAATGGTTGGC | 78 | 50 |
| 910141 | N/A | N/A | 60136 | 60155 | ATGTTCCACTAGTCTACCTC | 81 | 51 |
| 910147 | N/A | N/A | 86329 | 86348 | GCACAAGACTAAACAGAGTG | 106 | 52 |
| 910153 | N/A | N/A | 104618 | 104637 | GCACCAGTGGCCCCCTTAGT | 119 | 53 |
| 910159 | N/A | N/A | 114797 | 114816 | GCCCCCCATGGACAGAAATT | 66 | 54 |
| 910165 | N/A | N/A | 118897 | 118916 | GCAGCTTAGCTGAATGCCCT | 112 | 55 |
| 910171 | N/A | N/A | 121863 | 121882 | CATGGTGCCCCTTAGTATGC | 96 | 56 |
| 910177 | N/A | N/A | 125285 | 125304 | TGTTGACAGAAAGTCCCCTC | 69 | 57 |
| 910183 | N/A | N/A | 128499 128542 | 128518 128561 | GGAGTTAAACCATAGAGCCA | 63 | 58 |
| 910189 | N/A | N/A | 131428 | 131447 | CTCTCCAGCAAGCAACGGAC | 74 | 59 |
| 910195 | N/A | N/A | 135640 | 135659 | CGCCCATTAATCACTTGTTG | 78 | 60 |
| 910201 | N/A | N/A | 142375 | 142394 | CCACCATGTTTGCTTGGTGG | 79 | 61 |
| 910207 | N/A | N/A | 146958 | 146977 | CCCCACCATATTGCTGCACC | 86 | 62 |
| 910213 | N/A | N/A | 150788 | 150807 | GGGTGAAATAGCCTCTGTCG | 75 | 63 |
| 910219 | N/A | N/A | 154773 | 154792 | CCTTGTGTGGCTGCCCACGA | 115 | 64 |

TABLE 2-continued

Reduction of SCN2A RNA by 5-10-5 MOE gapmers with mixed PO/PS internucleoside linkages at 5000 nM concentration in SH-SY5Y cells

| Compound ID | SEQ ID NO: 1 Start Site | SEQ ID NO: 1 Stop Site | SEQ ID NO: 2 Start Site | SEQ ID NO: 2 Stop Site | Sequence (5' to 3') | SCN2A RNA (% control) | SEQ ID NO |
|---|---|---|---|---|---|---|---|
| 910225 | N/A | N/A | 158222 | 158241 | GGTGGAACAGTCTACTGCCC | 55 | 65 |
| 910231 | N/A | N/A | 161691 | 161710 | TAACCTGAATCCACTAGCCC | 85 | 66 |
| 910237 | N/A | N/A | 165153 | 165172 | GTTCATGGTTTGTCCAGGGC | 75 | 67 |
| 910243 | N/A | N/A | 168057 | 168076 | GGTCTGTAGCTCGGACCCCC | 39 | 68 |
| 910249 | N/A | N/A | 172552 | 172571 | GACTATTAGCCTCACTGCCT | 17 | 69 |
| 910255 | N/A | N/A | 175759 | 175778 | CCCCTGTCTCCGTGGAGCGA | 24 | 70 |
| 910261 | N/A | N/A | 179336 | 179355 | CCCCGTGGCAGATTGGCACC | 20 | 71 |
| 910267 | N/A | N/A | 182818 | 182837 | GCAGCACTCATGCTATCCCT | 16 | 72 |
| 910273 | N/A | N/A | 187114 | 187133 | AGGACCGTATGCTTGTTCAC | 36 | 73 |
| 910279 | N/A | N/A | 189972 | 189991 | GGCATTCTTCATAGGCAACT | 12 | 74 |
| 910285 | N/A | N/A | 196488 | 196507 | GCCTCACCTCTGGTAGGAGC | 43 | 75 |
| 910291 | N/A | N/A | 200571 | 200590 | TCACAGATTAAGCTGTCCCC | 17 | 76 |
| 910297 | N/A | N/A | 204970 | 204989 | TGTCCCCTCCCTACATAGTC | 39 | 77 |
| 910303 | N/A | N/A | 209576 | 209595 | GCTCCCATTTACCCTAATCC | 25 | 78 |
| 910309 | N/A | N/A | 214387 | 214406 | ATATCACCACTGTGGGCCGG | 55 | 79 |
| 910315 | N/A | N/A | 218046 | 218065 | TGGTCTAAACTATACATGGC | 19 | 80 |
| 910321 | N/A | N/A | 223836 | 223855 | TGGACTTCCTTTGTTACCGA | 15 | 81 |
| 910327 | N/A | N/A | 228592 | 228611 | CTTCCTCGCCAAACAGTTCG | 40 | 82 |
| 910333 | N/A | N/A | 231798 | 231817 | ACACCCTAGGAGCAAGAGTT | 20 | 83 |
| 910339 | N/A | N/A | 234815 | 234834 | GAACTGTAGTTTAACTGTGG | 32 | 84 |
| 910345 | N/A | N/A | 235696 | 235715 | CGTACTCTAGGCCCTATGGA | 13 | 85 |
| 910351 | N/A | N/A | 239653 | 239672 | GACCTCGGCTCATGCACTGC | 45 | 86 |
| 910357 | N/A | N/A | 242417 | 242436 | AGCTCCATACAAGGACCTAA | 20 | 87 |
| 910363 | N/A | N/A | 246343 | 246362 | GGCATTCAGTCTTACCCTCA | 14 | 88 |
| 910369 | N/A | N/A | 248839 | 248858 | CATTGTGTATGTCTATAGGG | 19 | 89 |
| 910375 | N/A | N/A | 252486 | 252505 | CCCTTGGTGTACCCTTCTCA | 25 | 90 |
| 910381 | N/A | N/A | 255582 | 255601 | GCTATTCTTACAGCAGGTCG | 11 | 91 |
| 910387 | N/A | N/A | 258291 | 258310 | TAACCTCTGTTGGGCTGCCT | 53 | 92 |
| 910393 | N/A | N/A | 259528 | 259547 | CAGGTAAGTAGTGTAAATAG | 27 | 93 |

TABLE 3

Reduction of SCN2A RNA by 5-10-5 MOE gapmers with mixed PO/PS internucleoside linkages at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 909934 | N/A | N/A | 166889 | 166908 | TAACTACCACTAGAGGGCGG | 96 | 94 |
| 909940 | N/A | N/A | 167087 | 167106 | GGGATTGATAAGCTGGCACC | 24 | 95 |
| 909946 | 381 | 400 | 168926 | 168945 | CGTTCCTGTTTGGGTCTCTT | 7 | 96 |
| 909952 | 1066 | 1085 | 183413 | 183432 | CAACTGCAATCCTATTAGCG | 31 | 97 |
| 909958 | 1195 | 1214 | 183542 | 183561 | GCTCACTGTCCTATTGAAAG | 3 | 98 |
| 909964 | 1842 | 1861 | 188651 | 188670 | GATTCCGATTTTCGGACTCT | 38 | 99 |
| 909970 | 2082 | 2101 | 196288 | 196307 | CTTCGGCTGTCATTGTCCTC | 22 | 100 |
| 909976 | 2138 | 2157 | 196344 | 196363 | GGCTGACATTGCTGTGGCGC | 15 | 101 |
| 909982 | 2490 | 2509 | 204392 | 204411 | GGTTTACAACAGTCCCAAAT | 26 | 102 |
| 909988 | 3471 | 3490 | 227465 | 227484 | CCGTCTTTGAGATAATTGAG | 5 | 103 |
| 909994 | 3705 | 3724 | 238170 | 238189 | CCAATATCAACCGTGCTGCC | 47 | 104 |
| 910000 | 3725 | 3744 | 238190 | 238209 | GTTCTCCCTCGGCGGGAGCT | 49 | 105 |
| 910006† | 3806 | 3825 | 240224 | 240243 | GACAACACTTGAACTTCCGT | 5 | 106 |
| 910011 | 4403 | 4422 | 247837 | 247856 | TGTTGACCACGCTTACATCA | 28 | 107 |
| 910017 | 4440 | 4459 | 247874 | 247893 | TGATTGCTCTCAATGAGAGC | 73 | 108 |
| 910023 | 4598 | 4617 | 253603 | 253622 | GGTTGTCTTCATACTTGGGT | 11 | 109 |
| 910029 | 6091 | 6110 | 262619 | 262638 | GGGTGTTCCATCACATTCTT | 59 | 110 |
| 910035 | 6359 | 6378 | 262887 | 262906 | GTGGGAGTCCTGTTGACACA | 50 | 111 |
| 910041 | 6486 | 6505 | 263014 | 263033 | ACCTCCCATCGATACTATTT | 46 | 112 |
| 910047 | 6543 | 6562 | 263071 | 263090 | CTGAGTAGCCATTACGCCTC | 45 | 113 |
| 910053 | 6944 | 6963 | 263472 | 263491 | CGAATAGCTATTTAAGCACC | 38 | 114 |
| 910058 | 7344 | 7363 | 263872 | 263891 | TATACTATGTCAACCTTACC | 51 | 115 |
| 910064 | 7753 | 7772 | 264281 | 264300 | GTCGGGCTTTTCATCATTGA | 27 | 116 |
| 910070 | 8031 | 8050 | 264559 | 264578 | TGTGTGCAAGTTTACAGTAC | 27 | 117 |
| 910076 | 8253 | 8272 | 264781 | 264800 | CAGTTCTAGTGCCATATGGG | 23 | 118 |
| 910082 | 8453 | 8472 | 264981 | 265000 | GGTTTACCGTTCTTTATGGT | 41 | 119 |
| 910088 | 8676 | 8695 | 265204 | 265223 | GTAGTTATCCAATACACTCT | 30 | 120 |
| 910094 | 2 | 21 | 112415 | 112434 | CGATGGTACCCAATGTCTGT | 73 | 121 |
| 910100 | 19 | 38 | 112432 | 112451 | CTGTTCTGACAGTCATTCGA | 87 | 122 |
| 910106 | N/A | N/A | 68149 | 68168 | GACAGACCACGCCAGTCTTC | 125 | 123 |
| 910112 | N/A | N/A | 67945 | 67964 | TCCACACCTAAATCAGGGCA | 88 | 124 |
| 910118 | N/A | N/A | 67975 | 67994 | CTGCATTCCCCGCTGCAGTA | 87 | 125 |
| 910124 | N/A | N/A | 81145 | 81164 | TAGTCCAGCAGAACAGTAGT | 96 | 126 |
| 910130 | N/A | N/A | 10920 | 10939 | GGCCATGGAGCACTACCCCA | 143 | 127 |
| 910136 | N/A | N/A | 45145 | 45164 | GTTAGTTAAGTAATGGTTGG | 95 | 128 |
|  | N/A | N/A | 45307 | 45326 |  |  |  |

TABLE 3-continued

Reduction of SCN2A RNA by 5-10-5 MOE gapmers
with mixed PO/PS internucleoside linkages
at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910142 | N/A | N/A | 61499 | 61518 | CGCGCCCTGCTGCACAGGTG | 177 | 129 |
| 910148 | N/A | N/A | 88505 | 88524 | CTACCCTTTTATTTGGGTAG | 88 | 130 |
| 910154 | N/A | N/A | 110407 | 110426 | ATGCTCACAATCTAGACTCC | 100 | 131 |
| 910160 | N/A | N/A | 115370 | 115389 | GGCCTCCTATGATATTGTTA | 68 | 132 |
| 910166 | N/A | N/A | 119784 | 119803 | GGCATGATTGCTGGGCATCA | 70 | 133 |
| 910172 | N/A | N/A | 122320 | 122339 | CCAGTGCTTTGCTCCACACG | 68 | 134 |
| 910178 | N/A | N/A | 125962 | 125981 | GCCCGTCCCCACTGACCAAT | 72 | 135 |
| 910184 | N/A | N/A | 128500 | 128519 | TGGAGTTAAACCATAGAGCC | 78 | 136 |
|  | N/A | N/A | 128543 | 128562 |  |  |  |
| 910190 | N/A | N/A | 131799 | 131818 | GCCTACTATAATAGCCCCCA | 75 | 137 |
| 910196 | N/A | N/A | 137199 | 137218 | TAGTGCAGGATTTTGCCCAC | 81 | 138 |
| 910202 | N/A | N/A | 142673 | 142692 | TGGTCACATATGAGGTCCAA | 93 | 139 |
| 910208 | N/A | N/A | 147833 | 147852 | AGCCCGGGCTGCCCGGAAAA | 111 | 140 |
| 910214 | N/A | N/A | 151191 | 151210 | ATAATGTGCTCACGGTCTTC | 91 | 141 |
| 910220 | N/A | N/A | 155700 | 155719 | CCCCAGCTGCGAGTAGTGCC | 64 | 142 |
| 910226 | N/A | N/A | 159287 | 159306 | GGTGAGCCCCATGTTCAGCC | 75 | 143 |
| 910232 | N/A | N/A | 162056 | 162075 | GTGGTTGTGGATAAGTGCGC | 91 | 144 |
| 910238 | N/A | N/A | 165156 | 165175 | TTGGTTCATGGTTTGTCCAG | 81 | 145 |
| 910244 | N/A | N/A | 168609 | 168628 | GAATCTCATATGTGCATCCA | 22 | 146 |
| 910250 | N/A | N/A | 173305 | 173324 | ATGTTGCATCCCAATGCTTA | 21 | 147 |
| 910256 | N/A | N/A | 176729 | 176748 | AGGGTCAAGTTTTTACGCTT | 10 | 148 |
| 910262 | N/A | N/A | 180045 | 180064 | GCAGGTATAGCCAATGCCCT | 29 | 149 |
| 910268 | N/A | N/A | 183262 | 183281 | AACAGCTATTTTACCGGCAA | 34 | 150 |
| 910274 | N/A | N/A | 187485 | 187504 | CCACCTCTGGTGATACTGCA | 33 | 151 |
| 910280 | N/A | N/A | 191068 | 191087 | CAGACACGATGGGCCCTCCA | 34 | 152 |
| 910286 | N/A | N/A | 197133 | 197152 | GTGATTGGTTTTGGGCCACT | 15 | 153 |
| 910292 | N/A | N/A | 201329 | 201348 | GCTAACGCAGGCGAGGTTGG | 17 | 154 |
| 910298 | N/A | N/A | 205501 | 205520 | GATACAGTTTCCCAACTGCG | 19 | 155 |
| 910304 | N/A | N/A | 209963 | 209982 | CTATGTACCGCTTTAATCTA | 36 | 156 |
| 910310 | N/A | N/A | 214947 | 214966 | CCTAGCAGTGCGGGCTTCCA | 42 | 157 |
| 910316 | N/A | N/A | 218623 | 218642 | CGGTGTGCTGTGACCCATCT | 21 | 158 |
| 910322 | N/A | N/A | 224270 | 224289 | GCAGCCAATCTACCCGTGGT | 26 | 159 |
| 910328 | N/A | N/A | 229258 | 229277 | GTAATTCTTTGCCCCAGGAC | 14 | 160 |
| 910334 | N/A | N/A | 232338 | 232357 | ACCCTTGCCTCTTTCCGAGA | 37 | 161 |
| 910340 | N/A | N/A | 235294 | 235313 | GCTCCCTTTCATTTTAGTGC | 22 | 162 |
| 910346 | N/A | N/A | 236310 | 236329 | GACTTCGGGTGACCCCAAGG | 33 | 163 |

TABLE 3-continued

Reduction of SCN2A RNA by 5-10-5 MOE gapmers with mixed PO/PS internucleoside linkages at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910352 | N/A | N/A | 240745 | 240764 | GCTCCTACCGGCACCCATGC | 47 | 164 |
| 910358 | N/A | N/A | 242892 | 242911 | TTGGTCTCAGTGTACCCCCA | 22 | 165 |
| 910364 | N/A | N/A | 246704 | 246723 | CACAGCGGAGTAGTGAAGAA | 32 | 166 |
| 910370 | N/A | N/A | 249680 | 249699 | CCCTTTTCAACCCCCCTTGG | 57 | 167 |
| 910376 | N/A | N/A | 253093 | 253112 | GAACAGTGGCGGCCAGTAGT | 13 | 168 |
| 910382 | N/A | N/A | 255973 | 255992 | ACACCCCTACCACTACAGGT | 47 | 169 |
| 910388 | N/A | N/A | 259152 | 259171 | TCTTAATGCTACCTCATAGC | 76 | 170 |
|  | N/A | N/A | 260854 | 260873 |  |  |  |
| 910394 | N/A | N/A | 260307 | 260326 | CAGGAGTATGACCAGGTACA | 52 | 171 |

TABLE 4

Reduction of SCN2A RNA by 5-10-5 MOE gapmers with mixed PO/PS internucleoside linkages at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 909935 | N/A | N/A | 166891 | 166910 | TGTAACTACCACTAGAGGGC | 81 | 172 |
| 909941 | N/A | N/A | 167093 | 167112 | GAGTTTGGGATTGATAAGCT | 29 | 173 |
| 909947 | 566 | 585 | 170037 | 170056 | ATCGAGAGATTGCTTTCCCT | 9 | 174 |
| 909953 | 1116 | 1135 | 183463 | 183482 | GAATTATCTGGAGGCCATTG | 23 | 175 |
| 909959 | 1671 | 1690 | 188480 | 188499 | GATTCAGCAGATGCGGCTGC | 28 | 176 |
| 909965 | 1989 | 2008 | 196195 | 196214 | AGGCTCGCCCTACTGTTGCG | 21 | 177 |
| 909971 | 2084 | 2103 | 196290 | 196309 | CTCTTCGGCTGTCATTGTCC | 32 | 178 |
| 909977 | 2236 | 2255 | 196442 | 196461 | GCCCCCGACCAGGGAGACCA | 49 | 179 |
| 909983 | 2494 | 2513 | 204396 | 204415 | CCATGGTTTACAACAGTCCC | 28 | 180 |
| 909989 | 3499 | 3518 | 227493 | 227512 | GCTGCCTATGCCACTAGTAG | 12 | 181 |
| 909995 | 3708 | 3727 | 238173 | 238192 | GCTCCAATATCAACCGTGCT | 21 | 182 |
| 910001 | 3729 | 3748 | 238194 | 238213 | GGCTGTTCTCCCTCGGCGGG | 35 | 183 |
| 910007† | 3880 | 3899 | 240298 | 240317 | GTGCTCCACTATCTTATAGC | 3 | 184 |
| 910012 | 4406 | 4425 | 247840 | 247859 | AGTTGTTGACCACGCTTACA | 20 | 185 |
| 910018 | 4443 | 4462 | 247877 | 247896 | GTTTGATTGCTCTCAATGAG | 34 | 186 |
| 910024 | 5020 | 5039 | 259936 | 259955 | GTAACGAAGAGAGATCAGTT | 37 | 187 |
| 910030 | 6095 | 6114 | 262623 | 262642 | TGATGGGTGTTCCATCACAT | 67 | 188 |
| 910036 | 6362 | 6381 | 262890 | 262909 | CCTGTGGGAGTCCTGTTGAC | 48 | 189 |
| 910042 | 6489 | 6508 | 263017 | 263036 | GAAACCTCCCATCGATACTA | 49 | 190 |
| 910048 | 6545 | 6564 | 263073 | 263092 | GTCTGAGTAGCCATTACGCC | 66 | 191 |

TABLE 4-continued

Reduction of SCN2A RNA by 5-10-5 MOE gapmers
with mixed PO/PS internucleoside linkages
at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910054 | 6946 | 6965 | 263474 | 263493 | TACGAATAGCTATTTAAGCA | 37 | 192 |
| 910059 | 7528 | 7547 | 264056 | 264075 | GCTTCAAACTATAATGGAAC | 33 | 193 |
| 910065 | 7756 | 7775 | 264284 | 264303 | ACAGTCGGGCTTTTCATCAT | 23 | 194 |
| 910071 | 8173 | 8192 | 264701 | 264720 | GACTAGGTGGAAACATTGGA | 32 | 195 |
| 910077 | 8257 | 8276 | 264785 | 264804 | GATACAGTTCTAGTGCCATA | 26 | 196 |
| 910083 | 8455 | 8474 | 264983 | 265002 | GTGGTTTACCGTTCTTTATG | 23 | 197 |
| 910089 | 8705 | 8724 | 265233 | 265252 | CCATATCTAGCTTTTTGGCC | 56 | 198 |
| 910095 | 6 | 25 | 112419 | 112438 | CATTCGATGGTACCCAATGT | 61 | 199 |
| 910101 | N/A | N/A | 68125 | 68144 | GTTTGGTTGCTACAATCCCT | 90 | 200 |
| 910107 | N/A | N/A | 68151 | 68170 | CAGACAGACCACGCCAGTCT | 105 | 201 |
| 910113 | N/A | N/A | 67952 | 67971 | GGCATCATCCACACCTAAAT | 146 | 202 |
| 910119 | N/A | N/A | 67979 | 67998 | TACTCTGCATTCCCCGCTGC | 129 | 203 |
| 910125 | N/A | N/A | 81153 | 81172 | CACTTCATTAGTCCAGCAGA | 84 | 204 |
| 910131 | N/A | N/A | 13052 | 13071 | ATTGGCCCACATATGTCAAT | 82 | 205 |
| 910137 | N/A | N/A | 45146 | 45165 | GGTTAGTTAAGTAATGGTTG | 82 | 206 |
| 910143 | N/A | N/A | 66809 | 66828 | GCTAGACAAATCCCAATCCT | 98 | 207 |
| 910149 | N/A | N/A | 92636 | 92655 | GCTTTCCAGTGCGCCCCAGG | 100 | 208 |
| 910155 | N/A | N/A | 110587 | 110606 | GCACGCCACCTCATGCCCCC | 106 | 209 |
| 910161 | N/A | N/A | 115772 | 115791 | GTCTCTTCCACGACCTTGGT | 92 | 210 |
| 910167 | N/A | N/A | 119798 | 119817 | ATCTAGGGACATGTGGCATG | 86 | 211 |
| 910173 | N/A | N/A | 122696 | 122715 | GACTCTTTAGGAGAGTTAAC | 75 | 212 |
| 910179 | N/A | N/A | 126382 | 126401 | AGGCTATAAGTGGCCTCTCA | 48 | 213 |
| 910185 | N/A | N/A | 128584 | 128603 | GGGTTAAACCATAGAGCCAT | 100 | 214 |
| 910191 | N/A | N/A | 132879 | 132898 | GATTCCGTGAATGGGTCTGG | 77 | 215 |
| 910197 | N/A | N/A | 137619 | 137638 | CCTATCAGAGGGTGTGTGAC | 74 | 216 |
| 910203 | N/A | N/A | 143552 | 143571 | GGCGATAGTAGCCAGAGTCC | 60 | 217 |
| 910209 | N/A | N/A | 147840 | 147859 | ATAGCCAAGCCCGGGCTGCC | 97 | 218 |
| 910215 | N/A | N/A | 151615 | 151634 | CCTCTTACCAACCCCCACGA | 77 | 219 |
| 910221 | N/A | N/A | 155704 | 155723 | GAGGCCCCAGCTGCGAGTAG | 94 | 220 |
| 910227 | N/A | N/A | 160224 | 160243 | CGCCGTAACCAGGCCATAAC | 63 | 221 |
| 910233 | N/A | N/A | 162830 | 162849 | CTCTCCCATTGATTCTAGCC | 56 | 222 |
| 910239 | N/A | N/A | 166137 | 166156 | GATATTAGCCTCAGCCCCAG | 72 | 223 |
| 910245 | N/A | N/A | 169307 | 169326 | TTCCCGCGCTGGAGGATGCC | 28 | 224 |
| 910251 | N/A | N/A | 173911 | 173930 | ATCGGTCCCAGTCTCCTTGC | 15 | 225 |
| 910257 | N/A | N/A | 176731 | 176750 | CTAGGGTCAAGTTTTTACGC | 14 | 226 |
| 910263 | N/A | N/A | 180777 | 180796 | GCACTACCATGCCTTCACCA | 7 | 227 |

TABLE 4-continued

Reduction of SCN2A RNA by 5-10-5 MOE gapmers with mixed PO/PS internucleoside linkages at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910269 | N/A | N/A | 183973 | 183992 | GCATCAACCAAATAGGGCCA | 5 | 228 |
| 910275 | N/A | N/A | 188458 | 188477 | CTGCCGCCTAGAAGGGCGCA | 79 | 229 |
| 910281 | N/A | N/A | 191544 | 191563 | GTGCCCCATCCGTTAGCATC | 33 | 230 |
| 910287 | N/A | N/A | 197777 | 197796 | AGGTTCAGTAACCAGCATAC | 35 | 231 |
| 910293 | N/A | N/A | 201697 | 201716 | AACCCCATGTCACATAGTTC | 44 | 232 |
| 910299 | N/A | N/A | 206261 | 206280 | CGTAAGACCAGCCCCAGCTT | 39 | 233 |
| 910305 | N/A | N/A | 210937 | 210956 | AGCTGTCTACATACCCCTGA | 33 | 234 |
| 910311 | N/A | N/A | 215590 | 215609 | GGTGGTATGGCAATCCAATT | 18 | 235 |
| 910317 | N/A | N/A | 220917 | 220936 | ATCCCTCAGTCACTGGGTAC | 36 | 236 |
| 910323 | N/A | N/A | 225034 | 225053 | ATCAATCCTTCCCCAGGGCG | 27 | 237 |
| 910329 | N/A | N/A | 229738 | 229757 | CGCTCTTTTGGAAAACCCAC | 13 | 238 |
| 910335 | N/A | N/A | 232818 | 232837 | TGCTCAGTAGATTACCAGTG | 11 | 239 |
| 910341 | N/A | N/A | 235624 | 235643 | GGATAATACACCAATATAGT | 19 | 240 |
| 910347 | N/A | N/A | 237210 | 237229 | GGCCACAGCATTCTCGGACC | 39 | 241 |
| 910353 | N/A | N/A | 241447 | 241466 | AGGACGGGTACCTGGCGAGG | 58 | 242 |
| 910359 | N/A | N/A | 243777 | 243796 | GGCTACTTGGTCAATAGCCA | 63 | 243 |
| 910365 | N/A | N/A | 247097 | 247116 | ACACCATTCATCTCTAGTTG | 33 | 244 |
| 910371 | N/A | N/A | 250433 | 250452 | TGTTTTGCGATATGCATTGA | 17 | 245 |
| 910377 | N/A | N/A | 254187 255580 | 254206 255599 | TATTCTTACAGCAGGTCGAG | 21 | 246 |
| 910383 | N/A | N/A | 256523 | 256542 | GTTAACGGTTTCTTACTGCT | 19 | 247 |
| 910389 | N/A | N/A | 259509 | 259528 | GGGAAGCTCCATGTCAGATC | 28 | 248 |
| 910395 | N/A | N/A | 260723 | 260742 | CCCCAAATAGGTAGAACCTT | 56 | 249 |

TABLE 5

Reduction of SCN2A RNA by 5-10-5 MOE gapmers with mixed PO/PS internucleoside linkages at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 909936 | N/A | N/A | 166893 | 166912 | ATTGTAACTACCACTAGAGG | 65 | 250 |
| 909942 | 285 | 304 | 168830 | 168849 | GGCGGTACCAGCACTGACTG | 20 | 251 |
| 909948 | 1055 | 1074 | 183402 | 183421 | CTATTAGCGCAAACACGCTT | 29 | 252 |
| 909954 | 1174 | 1193 | 183521 | 183540 | AGTACCATTCCCATCCAATG | 17 | 253 |
| 909960 | 1674 | 1693 | 188483 | 188502 | CTTGATTCAGCAGATGCGGC | 38 | 254 |
| 909966 | 1993 | 2012 | 196199 | 196218 | GAAAGGCTCGCCCTACTGT | 39 | 255 |

TABLE 5-continued

Reduction of SCN2A RNA by 5-10-5 MOE gapmers
with mixed PO/PS internucleoside linkages
at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 909972 | 2088 | 2107 | 196294 | 196313 | GAGTCTCTTCGGCTGTCATT | 39 | 256 |
| 909978 | 2243 | 2262 | 196449 | 196468 | TAGAAGGGCCCCCGACCAGG | 52 | 257 |
| 909984 | 2503 | 2522 | 204405 | 204424 | CACCTTTAACCATGGTTTAC | 60 | 258 |
| 909990 | 3531 | 3550 | 227525 | 227544 | TCACTTTCATCCACGACATA | 22 | 259 |
| 909996 | 3712 | 3731 | 238177 | 238196 | GGGAGCTCCAATATCAACCG | 18 | 260 |
| 910002† | 3752 | 3771 | 238217 | 238236 | GGGATTCCTCAGGTTCAACC | 19 | 261 |
| 910008 | 4128 | 4147 | 246225 | 246244 | GTTAAGCTAACCAGTGAGAC | 39 | 262 |
| 910013 | 4410 | 4429 | 247844 | 247863 | CTGTAGTTGTTGACCACGCT | 15 | 263 |
| 910019 | 4447 | 4466 | 247881 | 247900 | GGCAGTTTGATTGCTCTCAA | 26 | 264 |
| 910025 | 5031 | 5050 | 259947 | 259966 | GTGAAATAGTAGTAACGAAG | 38 | 265 |
| 910031 | 6098 | 6117 | 262626 | 262645 | CTTTGATGGGTGTTCCATCA | 64 | 266 |
| 910037 | 6368 | 6387 | 262896 | 262915 | AGACCTCCTGTGGGAGTCCT | 61 | 267 |
| 910043 | 6491 | 6510 | 263019 | 263038 | TAGAAACCTCCCATCGATAC | 46 | 268 |
| 910049 | 6564 | 6583 | 263092 | 263111 | CTTTAAATTGGTTCCTATCG | 80 | 269 |
| 910055 | 7173 | 7192 | 263701 | 263720 | GATAGTCATGCTGCTGGGAC | 45 | 270 |
| 910060 | 7607 | 7626 | 264135 | 264154 | GGCTTCCCATATTAGACTTC | 25 | 271 |
| 910066 | 7758 | 7777 | 264286 | 264305 | GTACAGTCGGGCTTTTCATC | 35 | 272 |
| 910072 | 8243 | 8262 | 264771 | 264790 | GCCATATGGGTCAATAAGAT | 19 | 273 |
| 910078 | 8275 | 8294 | 264803 | 264822 | GGATCCCATATTATATCTGA | 60 | 274 |
| 910084 | 8460 | 8479 | 264988 | 265007 | GTAATGTGGTTTACCGTTCT | 36 | 275 |
| 910090 | 8723 | 8742 | 265251 | 265270 | CCACTAGTCTACCTGATGCC | 78 | 276 |
| 910096 | 8 | 27 | 112421 | 112440 | GTCATTCGATGGTACCCAAT | 83 | 277 |
| 910102 | N/A | N/A | 68127 | 68146 | CAGTTTGGTTGCTACAATCC | 124 | 278 |
| 910108 | N/A | N/A | 67895 | 67914 | CCAATGATGTGCTCGGAGCC | 115 | 279 |
| 910114 | N/A | N/A | 67958 | 67977 | GTAAGTGGCATCATCCACAC | 124 | 280 |
| 910120 | N/A | N/A | 68026 | 68045 | GAGCACTGAACAGCATCCCC | 82 | 281 |
| 910126 | N/A | N/A | 81155 | 81174 | GGCACTTCATTAGTCCAGCA | 105 | 282 |
| 910132 | N/A | N/A | 25045 | 25064 | TCGGGACATAGTTATGTTGT | 73 | 283 |
| 910138 | N/A | N/A | 45303 | 45322 | GTTAAGTAATGGTTGGCTCT | 116 | 284 |
| 910144 | N/A | N/A | 72609 | 72628 | ACCACAAGTTTCAATGTGCC | 69 | 285 |
| 910150 | N/A | N/A | 97682 | 97701 | AACTAATGAGGTCCTAGGCT | 97 | 286 |
| 910156 | N/A | N/A | 112991 | 113010 | GAGCCACTGCCATGTTAATC | 65 | 287 |
| 910162 | N/A | N/A | 116308 | 116327 | CCCGGCCATGACATTGACTC | 72 | 288 |
| 910168 | N/A | N/A | 120435 | 120454 | GGCAATAGGGTGGTCATCAG | 79 | 289 |
| 910174 | N/A | N/A | 123275 | 123294 | GTAGGACATAGTTATGTTGT | 59 | 290 |

TABLE 5-continued

Reduction of SCN2A RNA by 5-10-5 MOE gapmers
with mixed PO/PS internucleoside linkages
at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910180 | N/A | N/A | 127396 | 127415 | TTTCCGAAAGAACACCCTCA | 84 | 291 |
| 910186 | N/A | N/A | 128915 | 128934 | CCATCAAGTTTCTGGTAGGG | 57 | 292 |
| 910192 | N/A | N/A | 133286 | 133305 | TGCCCGCACTCCATGGATCA | 78 | 293 |
| 910198 | N/A | N/A | 138615 | 138634 | CTATGGAGGTTGATAGTGGG | 101 | 294 |
| 910204 | N/A | N/A | 144488 | 144507 | TTGGTTACACCAAGCCAGGC | 77 | 295 |
| 910210 | N/A | N/A | 148389 | 148408 | GTGGTACAAATTGCTCCAGG | 65 | 296 |
| 910216 | N/A | N/A | 152213 | 152232 | GATGGAAGCTAACTCCCCCT | 87 | 297 |
| 910222 | N/A | N/A | 156329 | 156348 | GATCCCTAGTCCTGAGTGCT | 100 | 298 |
| 910228 | N/A | N/A | 160587 | 160606 | ACGGTCAGGTGGTTACTAAA | 86 | 299 |
| 910234 | N/A | N/A | 163742 | 163761 | GTCCTACTGCAATCAAGCGC | 87 | 300 |
| 910240 | N/A | N/A | 166626 | 166645 | GTAGTGCACTGCTTAATGGC | 93 | 301 |
| 910246 | N/A | N/A | 170179 | 170198 | GTGTAGCTCAATAACTTGGT | 11 | 302 |
| 910252 | N/A | N/A | 174379 | 174398 | TACTAGTGTGATTTGGAGGG | 26 | 303 |
| 910258 | N/A | N/A | 177000 | 177019 | ATGCTGCATTATGGACTCGG | 9 | 304 |
| 910264 | N/A | N/A | 181552 | 181571 | CACTTCCAGGTTGGTCCCCC | 15 | 305 |
| 910270 | N/A | N/A | 184951 | 184970 | GCCACCCTGTTTAGGTGGCA | 91 | 306 |
| 910276 | N/A | N/A | 188459 | 188478 | GCTGCCGCCTAGAAGGGCGC | 72 | 307 |
| 910282 | N/A | N/A | 192994 | 193013 | CCGATGAGGCTTTGTTTGGA | 16 | 308 |
| 910288 | N/A | N/A | 198263 | 198282 | GCTTCAAGCTGGCCCCAACT | 34 | 309 |
| 910294 | N/A | N/A | 202319 | 202338 | GCGCTTCTAACTCACCCTCC | 32 | 310 |
| 910300 | N/A | N/A | 207031 | 207050 | GCGCTTGTTACTCCCTAGGA | 16 | 311 |
| 910306 | N/A | N/A | 211928 | 211947 | CGCCCGGCTAGATGTAGGGT | 47 | 312 |
| 910312 | N/A | N/A | 216181 | 216200 | GTAACCGTGTACAGCCTCTG | 22 | 313 |
| 910318 | N/A | N/A | 221714 | 221733 | CAGCCCCAGTCAAGATAACT | 52 | 314 |
| 910324 | N/A | N/A | 226106 | 226125 | ATAGGCTCCACCAGTATGAA | 28 | 315 |
| 910330 | N/A | N/A | 230447 | 230466 | GTCCACTCAGTCTGCCTTAT | 10 | 316 |
| 910336 | N/A | N/A | 233677 | 233696 | GTAGCATAGCCCTTGCCTAG | 19 | 317 |
| 910342 | N/A | N/A | 235631 | 235650 | GCCATATGGATAATACACCA | 9 | 318 |
| 910348 | N/A | N/A | 238060 | 238079 | ATTAGGTGTGCCCCCCCCCC | 69 | 319 |
| 910354 | N/A | N/A | 241551 | 241570 | CAATAGCGAATCAGTGTGAA | 34 | 320 |
| 910360 | N/A | N/A | 244598 | 244617 | CCCGCCCTGCATGTCATGCA | 68 | 321 |
| 910366 | N/A | N/A | 247538 | 247557 | ACTAGACTCTGGTAGCTCCA | 12 | 322 |
| 910372 | N/A | N/A | 250934 | 250953 | TGACCAGGACTATCAGAGCC | 23 | 323 |
| 910378 | N/A | N/A | 254189 | 254208 | GTTATTCTTACAGCAGGTCG | 15 | 324 |
| 910384 | N/A | N/A | 257640 | 257659 | CCACTTGTTTTGAGGCCCCT | 49 | 325 |

TABLE 5-continued

Reduction of SCN2A RNA by 5-10-5 MOE gapmers
with mixed PO/PS internucleoside linkages
at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910390 | N/A | N/A | 259516 | 259535 | GTAAATAGGGAAGCTCCATG | 43 | 326 |
| 910396 | N/A | N/A | 260802 | 260821 | GTTACAATGTTCTATTCGAC | 49 | 327 |

TABLE 6

Reduction of SCN2A RNA by 5-10-5 MOE gapmers
with mixed PO/PS internucleoside linkages
at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 909533 | 4131 | 4150 | 246228 | 246247 | GCAGTTAAGCTAACCAGTGA | 15 | 328 |
| 909937 | N/A | N/A | 166922 | 166941 | TTCCTGTACAGGGACTACAA | 68 | 329 |
| 909943 | 316 | 335 | 168861 | 168880 | CCTGGTAAAGAAGCGGAAGC | 31 | 330 |
| 909949 | 1058 | 1077 | 183405 | 183424 | ATCCTATTAGCGCAAACACG | 24 | 331 |
| 909955 | 1177 | 1196 | 183524 | 183543 | AGTAGTACCATTCCCATCCA | 11 | 332 |
| 909961 | 1676 | 1695 | 188485 | 188504 | CTCTTGATTCAGCAGATGCG | 28 | 333 |
| 909967 | 1996 | 2015 | 196202 | 196221 | GCTGAAAAGGCTCGCCCTAC | 13 | 334 |
| 909973 | 2090 | 2109 | 196296 | 196315 | GAGAGTCTCTTCGGCTGTCA | 30 | 335 |
| 909979 | 2324 | 2343 | 199881 | 199900 | GATAAGAACTGGACCGTCTC | 25 | 336 |
| 909985 | 3430 | 3449 | 227424 | 227443 | GGTATGGTTGGAAATACAGC | 11 | 337 |
| 909991 | 3641 | 3660 | 227635 | 227654 | TATCTGACTCGCTGCTGAAT | 47 | 338 |
| 909997 | 3715 | 3734 | 238180 | 238199 | GGCGGGAGCTCCAATATCAA | 37 | 339 |
| 910003† | 3797 | 3816 | 240215 | 240234 | TGAACTTCCGTACACAGTCT | 7 | 340 |
| 910014 | 4414 | 4433 | 247848 | 247867 | CTCACTGTAGTTGTTGACCA | 19 | 341 |
| 910020 | 4450 | 4469 | 247884 | 247903 | CCTGGCAGTTTGATTGCTCT | 24 | 342 |
| 910026 | 5033 | 5052 | 259949 | 259968 | TAGTGAAATAGTAGTAACGA | 31 | 343 |
| 910032 | 6149 | 6168 | 262677 | 262696 | CGGTTTTCTCTGGAGTTGAA | 45 | 344 |
| 910038 | 6373 | 6392 | 262901 | 262920 | GGCATAGACCTCCTGTGGGA | 54 | 345 |
| 910044 | 6493 | 6512 | 263021 | 263040 | AATAGAAACCTCCCATCGAT | 78 | 346 |
| 910050 | 6569 | 6588 | 263097 | 263116 | CCCCCCTTTAAATTGGTTCC | 38 | 347 |
| 910056 | 7247 | 7266 | 263775 | 263794 | GGTCAATTCAGGCTTCTTAG | 23 | 348 |
| 910061 | 7610 | 7629 | 264138 | 264157 | TATGGCTTCCCATATTAGAC | 20 | 349 |
| 910067 | 7762 | 7781 | 264290 | 264309 | GTTTGTACAGTCGGGCTTTT | 24 | 350 |
| 910073 | 8245 | 8264 | 264773 | 264792 | GTGCCATATGGGTCAATAAG | 20 | 351 |
| 910079 | 8323 | 8342 | 264851 | 264870 | GGTAATATAACTTCACTACC | 35 | 352 |
| 910085 | 8464 | 8483 | 264992 | 265011 | GATTGTAATGTGGTTTACCG | 37 | 353 |

TABLE 6-continued

Reduction of SCN2A RNA by 5-10-5 MOE gapmers with mixed PO/PS internucleoside linkages at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910091 | 8725 | 8744 | 265253 | 265272 | TTCCACTAGTCTACCTGATG | 58 | 354 |
| 910097 | 10 | 29 | 112423 | 112442 | CAGTCATTCGATGGTACCCA | 48 | 355 |
| 910103 | N/A | N/A | 68132 | 68151 | TTCAGCAGTTTGGTTGCTAC | 91 | 356 |
| 910109 | N/A | N/A | 67897 | 67916 | TGCCAATGATGTGCTCGGAG | 72 | 357 |
| 910115 | N/A | N/A | 67966 | 67985 | CCGCTGCAGTAAGTGGCATC | 81 | 358 |
| 910121 | N/A | N/A | 81130 | 81149 | GTAGTATTCCTCCAATCACT | 91 | 359 |
| 910127 | N/A | N/A | 81159 | 81178 | GAGTGGCACTTCATTAGTCC | 64 | 360 |
| 910133 | N/A | N/A | 38868 | 38887 | AGATCAATTGAATTGTTGGG | 69 | 361 |
| 910139 | N/A | N/A | 49570 | 49589 | CAAGTTCAAATGTGTAGTGC | 68 | 362 |
| 910145 | N/A | N/A | 83239 | 83258 | TCAGGACAAGCTATCAAGTA | 59 | 363 |
| 910151 | N/A | N/A | 101360 | 101379 | ATTGGCAGGCTATGCTTAAT | 105 | 364 |
| 910157 | N/A | N/A | 113713 | 113732 | ATCCTGATGCACCTCCACCG | 45 | 365 |
| 910163 | N/A | N/A | 116964 | 116983 | AAGAGCCACGGTGGCCCATC | 116 | 366 |
| 910169 | N/A | N/A | 121086 | 121105 | GGTGGCTTGAGCAGGGTAGC | 122 | 367 |
| 910175 | N/A | N/A | 123464 | 123483 | AGCAAGAGGGCACCGTTTCC | 100 | 368 |
| 910181 | N/A | N/A | 128203 | 128222 | AACTGCAGTTGATATACCCC | 58 | 369 |
| 910187 | N/A | N/A | 129655 | 129674 | GCAAGGGAGTCCAGTTGGAT | 43 | 370 |
| 910193 | N/A | N/A | 134589 | 134608 | GGTGTACCCCACTTGAGGTG | 64 | 371 |
| 910199 | N/A | N/A | 139454 | 139473 | GGCTTTCCCGGCCCTTACTC | 91 | 372 |
| 910205 | N/A | N/A | 145496 | 145515 | GGTCTGCAGGTTTGATCCCT | 98 | 373 |
| 910211 | N/A | N/A | 149375 | 149394 | ATTAGTTACCTTGGAGGGCC | 33 | 374 |
| 910217 | N/A | N/A | 152584 | 152603 | CCGTTTGTTTCCCATCCATC | 69 | 375 |
| 910223 | N/A | N/A | 157003 | 157022 | GCATAGGAGACCATGGGTTC | 45 | 376 |
| 910229 | N/A | N/A | 161047 | 161066 | GGATGGAATAGGTTGTGCAC | 30 | 377 |
| 910235 | N/A | N/A | 164328 | 164347 | GACAGACAAGTCCCGGTGGC | 94 | 378 |
| 910241 | N/A | N/A | 167416 | 167435 | TACCAGCTAGCAGACTGCCC | 43 | 379 |
| 910247 | N/A | N/A | 171039 | 171058 | CGTGTAAATGCCCCTGCCCC | 22 | 380 |
| 910253 | N/A | N/A | 174686 | 174705 | TTACAGCAGTTGCTGCTAGA | 23 | 381 |
| 910259 | N/A | N/A | 177827 | 177846 | CGCTAGGAGGTCTGATCCCT | 32 | 382 |
| 910265 | N/A | N/A | 181873 | 181892 | ATGCTTGGTCTGTCAAGGCA | 13 | 383 |
| 910271 | N/A | N/A | 186058 | 186077 | TCAGGCACCTCGCATGTGAG | 36 | 384 |
| 910277 | N/A | N/A | 189147 | 189166 | GAACAACCCCGCAGGTGGCC | 22 | 385 |
| 910283 | N/A | N/A | 193733 | 193752 | GTGCCCTGTATCTCTGCGGC | 19 | 386 |
| 910289 | N/A | N/A | 199584 | 199603 | GGAGGGACCAGGTCCACTAC | 51 | 387 |
| 910295 | N/A | N/A | 203237 | 203256 | ATGTGGCCACCACCTCTTAG | 32 | 388 |
| 910301 | N/A | N/A | 208608 | 208627 | GCTCTACCTTTAGGCCTATG | 21 | 389 |

TABLE 6-continued

Reduction of SCN2A RNA by 5-10-5 MOE gapmers
with mixed PO/PS internucleoside linkages
at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910307 | N/A | N/A | 212293 | 212312 | GGGCAAGAATTCACTACCTC | 20 | 390 |
| 910313 | N/A | N/A | 216623 | 216642 | TGTCAGGCTGAAAGTAGTGC | 16 | 391 |
| 910319 | N/A | N/A | 222077 | 222096 | GTAACCCTATGGCACTTTCT | 15 | 392 |
| 910325 | N/A | N/A | 226685 | 226704 | TTGTAGTGCCTCCTGCCCAC | 36 | 393 |
| 910331 | N/A | N/A | 230983 | 231002 | GTATGACTCAGCATAATAGC | 31 | 394 |
| 910337 | N/A | N/A | 234351 | 234370 | TGTAGGTTCAAGATAGTGCT | 24 | 395 |
| 910343 | N/A | N/A | 235679 | 235698 | GGATAATACACCAATATGGA | 20 | 396 |
| 910349 | N/A | N/A | 238413 | 238432 | ATGTACAGTTGTTGGATAGG | 48 | 397 |
| 910355 | N/A | N/A | 241553 | 241572 | GGCAATAGCGAATCAGTGTG | 10 | 398 |
| 910361 | N/A | N/A | 245087 | 245106 | TATAAGGACCTGTAGTACTT | 43 | 399 |
| 910367 | N/A | N/A | 248036 | 248055 | TCTAACAGGTGGATATCTCA | 22 | 400 |
| 910373 | N/A | N/A | 251285 | 251304 | AGCTAGCTGCTGGTGCTAGG | 24 | 401 |
| 910379 | N/A | N/A | 254815 | 254834 | GCGATTCTCCTGGCAGCAAC | 33 | 402 |
| 910385 | N/A | N/A | 258128 | 258147 | TCCAATGGTGATTTTGGAC | 36 | 403 |
| 910391 | N/A | N/A | 259525 260902 | 259544 260921 | GTAAGTAGTGTAAATAGGGA | 18 | 404 |
| 910397 | N/A | N/A | 260852 | 260871 | TTAATGCTACCTCATAGCAC | 39 | 405 |

TABLE 7

Reduction of SCN2A RNA by 5-10-5 MOE gapmers
with mixed PO/PS internucleoside linkages
at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 909603 | 7336 | 7355 | 263864 | 263883 | GTCAACCTTACCAAGAGCAG | 23 | 406 |
| 909938 | N/A | N/A | 166924 | 166943 | ATTTCCTGTACAGGGACTAC | 85 | 407 |
| 909944 | 320 | 339 | 168865 | 168884 | ATTCCCTGGTAAAGAAGCGG | 25 | 408 |
| 909950 | 1061 | 1080 | 183408 | 183427 | GCAATCCTATTAGCGCAAAC | 12 | 409 |
| 909956 | 1186 | 1205 | 183533 | 183552 | CCTATTGAAAGTAGTACCAT | 14 | 410 |
| 909962 | 1838 | 1857 | 188647 | 188666 | CCGATTTTCGGACTCTGTCA | 14 | 411 |
| 909968 | 2023 | 2042 | 196229 | 196248 | GCCAATGTCCTTTGCTCGAC | 30 | 412 |
| 909974 | 2092 | 2111 | 196298 | 196317 | CAGAGAGTCTCTTCGGCTGT | 35 | 413 |
| 909980 | 2363 | 2382 | 199920 | 199939 | GCCTTGATGTAGGATCTTCC | 6 | 414 |
| 909986 | 3433 | 3452 | 227427 | 227446 | GGTGGTATGGTTGGAAATAC | 21 | 415 |
| 909992 | 3644 | 3663 | 227638 | 227657 | CCATATCTGACTCGCTGCTG | 25 | 416 |
| 909998 | 3717 | 3736 | 238182 | 238201 | TCGGCGGGAGCTCCAATATC | 44 | 417 |

TABLE 7-continued

Reduction of SCN2A RNA by 5-10-5 MOE gapmers
with mixed PO/PS internucleoside linkages
at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910004† | 3799 | 3818 | 240217 | 240236 | CTTGAACTTCCGTACACAGT | 15 | 418 |
| 910009 | 4397 | 4416 | 247831 | 247850 | CCACGCTTACATCAAACATC | 30 | 419 |
| 910015 | 4417 | 4436 | 247851 | 247870 | GCACTCACTGTAGTTGTTGA | 8 | 420 |
| 910021 | 4499 | 4518 | 247933 | 247952 | ACAGATATCCAAGTCCTACG | 34 | 421 |
| 910027 | 6003 | 6022 | 262531 | 262550 | GCCCTCTGGATAATAATAGC | 53 | 422 |
| 910033 | 6156 | 6175 | 262684 | 262703 | GTCATATCGGTTTTCTCTGG | 40 | 423 |
| 910039 | 6480 | 6499 | 263008 | 263027 | CATCGATACTATTTCTCCAG | 47 | 424 |
| 910045 | 6537 | 6556 | 263065 | 263084 | AGCCATTACGCCTCTGCTCT | 44 | 425 |
| 910051 | 6572 | 6591 | 263100 | 263119 | CCTCCCCCTTTAAATTGGT | 58 | 426 |
| 910062 | 7655 | 7674 | 264183 | 264202 | GAATGAGGTCTTGGTAGAAC | 25 | 427 |
| 910068 | 7769 | 7788 | 264297 | 264316 | GCAACATGTTTGTACAGTCG | 15 | 428 |
| 910074 | 8248 | 8267 | 264776 | 264795 | CTAGTGCCATATGGGTCAAT | 27 | 429 |
| 910080 | 8446 | 8465 | 264974 | 264993 | CGTTCTTTATGGTAACAGCA | 16 | 430 |
| 910086 | 8469 | 8488 | 264997 | 265016 | GGCTTGATTGTAATGTGGTT | 34 | 431 |
| 910092 | 8731 | 8750 | 265259 | 265278 | GTAACTTTCCACTAGTCTAC | 68 | 432 |
| 910098 | 15 | 34 | 112428 | 112447 | TCTGACAGTCATTCGATGGT | 46 | 433 |
| 910104 | N/A | N/A | 68140 | 68159 | CGCCAGTCTTCAGCAGTTTG | 76 | 434 |
| 910110 | N/A | N/A | 67899 | 67918 | GGTGCCAATGATGTGCTCGG | 112 | 435 |
| 910116 | N/A | N/A | 67969 | 67988 | TCCCCGCTGCAGTAAGTGGC | 108 | 436 |
| 910122 | N/A | N/A | 81132 | 81151 | CAGTAGTATTCCTCCAATCA | 89 | 437 |
| 910128 | N/A | N/A | 81162 | 81181 | GTGGAGTGGCACTTCATTAG | 51 | 438 |
| 910134 | N/A | N/A | 45141 | 45160 | GTTAAGTAATGGTTGGCACC | 112 | 439 |
| 910140 | N/A | N/A | 58777 | 58796 | GTCAAGTTTTGAACTGACC | 96 | 440 |
| 910146 | N/A | N/A | 83241 | 83260 | GATCAGGACAAGCTATCAAG | 64 | 441 |
| 910152 | N/A | N/A | 102749 | 102768 | GTTACAAAAGTAGGGACTCA | 89 | 442 |
| 910158 | N/A | N/A | 114092 | 114111 | GTCTATGCCATCCTGATATG | 85 | 443 |
| 910164 | N/A | N/A | 118010 | 118029 | GAGGGATAGTGTCAGTCTTC | 67 | 444 |
| 910170 | N/A | N/A | 121443 | 121462 | AGGAGGTTAGTCATGCAAGT | 70 | 445 |
| 910176 | N/A | N/A | 124678 | 124697 | GAGTGCACCCCAAGGCTAGC | 57 | 446 |
| 910182 | N/A | N/A | 128498 128541 | 128517 128560 | GAGTTAAACCATAGAGCCAT | 36 | 447 |
| 910188 | N/A | N/A | 130065 | 130084 | TCCCATGGTTGGTCCTAGCC | 83 | 448 |
| 910194 | N/A | N/A | 135044 | 135063 | ATCCAGACCGTATTGCAACC | 73 | 449 |
| 910200 | N/A | N/A | 141973 | 141992 | CTACCCAGTAGCCCCTGGTA | 103 | 450 |
| 910206 | N/A | N/A | 146430 | 146449 | GTTGGCACTATAACCAATGC | 62 | 451 |
| 910212 | N/A | N/A | 150028 | 150047 | TGCTCTGTCGACACCTGTCT | 56 | 452 |

TABLE 7-continued

Reduction of SCN2A RNA by 5-10-5 MOE gapmers
with mixed PO/PS internucleoside linkages
at 5000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910218 | N/A | N/A | 153536 | 153555 | CACCGGCACTTCAGACTTGG | 82 | 453 |
| 910224 | N/A | N/A | 157533 | 157552 | GTAGATCTGAATGTCTGGGC | 74 | 454 |
| 910230 | N/A | N/A | 161147 | 161166 | TTAGGACAAGCTATCACCAG | 44 | 455 |
| 910236 | N/A | N/A | 164991 | 165010 | GTAGCAGCTCTAGCCTCCCA | 39 | 456 |
| 910242 | N/A | N/A | 168052 | 168071 | GTAGCTCGGACCCCCTGGCT | 42 | 457 |
| 910248 | N/A | N/A | 171979 | 171998 | TCATCATTCAGATGCACGAC | 20 | 458 |
| 910254 | N/A | N/A | 174799 | 174818 | GGTCTAAACTCTGGTGCTAT | 20 | 459 |
| 910260 | N/A | N/A | 178626 | 178645 | GGATGGTTCCTCCCCTTAGC | 28 | 460 |
| 910266 | N/A | N/A | 182069 | 182088 | ATTTCATGAGTGTCGCCATC | 17 | 461 |
| 910272 | N/A | N/A | 186570 | 186589 | TCAATAACGGCAAGTCTGCT | 54 | 462 |
| 910278 | N/A | N/A | 189529 | 189548 | TAGGTATTAAGGTTTCACTC | 21 | 463 |
| 910284 | N/A | N/A | 195317 | 195336 | GAGGCTCGGGTCTCCCAGTG | 38 | 464 |
| 910290 | N/A | N/A | 200118 | 200137 | ATCCATGAGTTATGCACGGA | 26 | 465 |
| 910296 | N/A | N/A | 203948 | 203967 | GATATCTCAGGAGATGTCCT | 38 | 466 |
| 910302 | N/A | N/A | 209203 | 209222 | GTGGTAACTCTACCCCAAAC | 33 | 467 |
| 910308 | N/A | N/A | 213398 | 213417 | AGGTGGTTACCTCAGAGACC | 25 | 468 |
| 910314 | N/A | N/A | 217259 | 217278 | GTGACTTGCTACCATAGAGC | 17 | 469 |
| 910320 | N/A | N/A | 222990 | 223009 | CTAGGCTGGCAGTCCCATCC | 35 | 470 |
| 910326 | N/A | N/A | 228033 | 228052 | GCAACTACCCTCTCATCAGA | 17 | 471 |
| 910332 | N/A | N/A | 231406 | 231425 | CCCATGCTGCTAGCAACTGA | 28 | 472 |
| 910338 | N/A | N/A | 234496 | 234515 | AGTTATAGCGAATCAGTGGT | 40 | 473 |
| 910344 | N/A | N/A | 235686 | 235705 | GCCCTATGGATAATACACCA | 15 | 474 |
| 910350 | N/A | N/A | 238835 | 238854 | CTCCAGTGACATATTGCCCC | 43 | 475 |
| 910356 | N/A | N/A | 241826 | 241845 | TTCGCCTTAGAGGCCTCCAG | 14 | 476 |
| 910362 | N/A | N/A | 245575 | 245594 | CATACAGTTGACTAATGTAG | 24 | 477 |
| 910368 | N/A | N/A | 248605 | 248624 | TCTGTTGTGCGGACATAGTA | 24 | 478 |
| 910374 | N/A | N/A | 251753 | 251772 | TTTGCAGCGGAAAAGGTCTG | 58 | 479 |
| 910380 | N/A | N/A | 255569 | 255588 | CAGGTCGAGGTATGGGTTAT | 33 | 480 |
| 910386 | N/A | N/A | 258254 | 258273 | TAGAATGACTAATACTCTGC | 24 | 481 |
| 910392 | N/A | N/A | 259526 260903 | 259545 260922 | GGTAAGTAGTGTAAATAGGG | 14 | 482 |
| 910398 | N/A | N/A | 261358 | 261377 | GACTCAACCCTGGAAGGTCC | 54 | 483 |

TABLE 8

Reduction of SCN2A RNA by 5-10-5 MOE gapmers
with mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 16 | 227 |
| 910388 | N/A | N/A | 259152 260854 | 259171 260873 | TCTTAATGCTACCTCATAGC | 68 | 170 |
| 1248329 | 24 | 43 | 112437 | 112456 | GCTTTCTGTTCTGACAGTCA | 70 | 484 |
| 1248355 | 372 | 391 | 168917 | 168936 | TTGGGTCTCTTAGCTTTCTC | 14 | 485 |
| 1248381 | 787 | 806 | 181698 | 181717 | TGCAAGTATTTTAATAAGTG | 37 | 486 |
| 1248407 | 1318 | 1337 | 186625 | 186644 | ACAGATGTATCCTTCAGGAC | 26 | 487 |
| 1248433 | 2329 | 2348 | 199886 | 199905 | AACATGATAAGAACTGGACC | 35 | 488 |
| 1248459 | 2539 | 2558 | 204441 | 204460 | AAATGGGTCCATTACAACCA | 58 | 489 |
| 1248485 | 3432 | 3451 | 227426 | 227445 | GTGGTATGGTTGGAAATACA | 16 | 490 |
| 1248511 | 3995 | 4014 | 243167 | 243186 | CAGCATATTCTAACATGGTC | 10 | 491 |
| 1248537 | 4540 | 4559 | 250604 | 250623 | AATATCCATCCATCCCTTAA | 60 | 492 |
| 1248562 | 6137 | 6156 | 262665 | 262684 | GAGTTGAATTCTCATTCAGT | 50 | 493 |
| 1248588 | 6872 | 6891 | 263400 | 263419 | TGTGATTTTTTATGTGTGA | 33 | 494 |
| 1248614 | 7218 | 7237 | 263746 | 263765 | ATAGGATATTTTTATTTTAT | 79 | 495 |
| 1248639 | 7395 | 7414 | 263923 | 263942 | ACTGGGTAAAATTACTATTT | 60 | 496 |
| 1248665 | 7518 | 7537 | 264046 | 264065 | ATAATGGAACCAATTACATC | 53 | 497 |
| 1248689 | 7820 | 7839 | 264348 | 264367 | TATTTTCTTAGAAAACTCTA | 71 | 498 |
| 1248714 | 8003 | 8022 | 264531 | 264550 | AAGCAGAAACCTACACTGCA | 60 | 499 |
| 1248740 | 8353 | 8372 | 264881 | 264900 | TTGTGAAACACAAAGTATTT | 57 | 500 |
| 1248766 | 8511 | 8530 | 265039 | 265058 | AACAATTAAATACAAAAACA | 88 | 501 |
| 1248792 | 8651 | 8670 | 265179 | 265198 | ATTAACTTCCATTCCATGAA | 81 | 502 |
| 1248816 | 8756 | 8775 | 265284 | 265303 | GTTAGTCAATTTTTATTAA | 62 | 503 |
| 1248842 | N/A | N/A | 114536 | 114555 | ATGACACATTTTAATCCCTT | 63 | 504 |
| 1248868 | N/A | N/A | 117743 | 117762 | TAACAACTTAAAACTATAAA | 81 | 505 |
| 1248894 | N/A | N/A | 124032 | 124051 | AACCATCACATCTTTTAGAA | 72 | 506 |
| 1248920 | N/A | N/A | 127323 | 127342 | ATAAAACATACAACTACTTA | 90 | 507 |
| 1248945 | N/A | N/A | 128525 128568 | 128544 128587 | CCATATTTTAATAATTGTTA | 69 | 508 |
| 1248971 | N/A | N/A | 141387 | 141406 | GTATCCCATTTATTGAGTTA | 76 | 509 |
| 1248997 | N/A | N/A | 144994 | 145013 | AAACTTTTTATACTAGTTA | 105 | 510 |
| 1249023 | N/A | N/A | 146258 | 146277 | CTTATTCAACTCTTTAATCA | 99 | 511 |
| 1249049 | N/A | N/A | 149445 | 149464 | GCTCATATTATAAATATATT | 77 | 512 |
| 1249075 | N/A | N/A | 152582 | 152601 | GTTTGTTTCCCATCCATCTA | 61 | 513 |
| 1249101 | N/A | N/A | 156410 | 156429 | ACATCTCTCCTCATATTCAT | 80 | 514 |
| 1249127 | N/A | N/A | 162374 | 162393 | TCTGATATTTCTATAATGTT | 55 | 515 |
| 1249153 | N/A | N/A | 166559 | 166578 | TTATAATACCATATTTTTTA | 113 | 516 |

TABLE 8-continued

Reduction of SCN2A RNA by 5-10-5 MOE gapmers
with mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249179 | N/A | N/A | 170517 | 170536 | TATGTATATTTATTTTCCAA | 33 | 517 |
| 1249205 | N/A | N/A | 171909 | 171928 | ATCTGATTCTCTAATCTCTG | 14 | 518 |
| 1249231 | N/A | N/A | 172653 | 172672 | AATCAGTTACTAACTACAGC | 31 | 519 |
| 1249257 | N/A | N/A | 174419 | 174438 | CCATTTTCCTACCATTTTCA | 23 | 520 |
| 1249283 | N/A | N/A | 175700 | 175719 | CAGATACATCCCTTACCAGC | 28 | 521 |
| 1249309 | N/A | N/A | 176889 | 176908 | AGAGAAATAATTATTTTCTA | 82 | 522 |
| 1249335 | N/A | N/A | 177800 | 177819 | TCTCCAGTTTCATTTTCTTT | 22 | 523 |
| 1249361 | N/A | N/A | 178410 | 178429 | ACATAACCATTATATACCCA | 24 | 524 |
| 1249387 | N/A | N/A | 179803 | 179822 | CCTAATGTTTTACTATAAA | 62 | 525 |
| 1249413 | N/A | N/A | 180553 | 180572 | ATTTATCAACTTAAATTTTC | 75 | 526 |
| 1249439 | N/A | N/A | 181448 | 181467 | ATATTGCATTTTCCACATTA | 34 | 527 |
| 1249465 | N/A | N/A | 183699 | 183718 | TTAAATCATCTTAAATTAGT | 92 | 528 |
| 1249491 | N/A | N/A | 184369 184401 | 184388 184420 | ATCTAGTTTTTATTTTTAAG | 84 | 529 |
| 1249517 | N/A | N/A | 185479 | 185498 | AATATGCTAAATACTCCCCA | 32 | 530 |
| 1249543 | N/A | N/A | 186071 | 186090 | AACTTGCTAATCTTCAGGCA | 53 | 531 |
| 1249569 | N/A | N/A | 188074 | 188093 | ATTCCATTTTCACACAATAA | 21 | 532 |
| 1249595 | N/A | N/A | 190182 | 190201 | CCTATGTTAAATTTGAATTA | 72 | 533 |
| 1249621 | N/A | N/A | 192560 | 192579 | TTAAACCTCTTCCTTTGCCA | 25 | 534 |
| 1249647 | N/A | N/A | 200316 | 200335 | AAGCAGTTAATATAATCCAA | 32 | 535 |
| 1249673 | N/A | N/A | 200756 | 200775 | ATATTGATAATATTTATTAA | 98 | 536 |
| 1249699 | N/A | N/A | 202762 | 202781 | AACCTATATTTACATTGAA | 53 | 537 |
| 1249725 | N/A | N/A | 203198 | 203217 | TTTCTTCTTTTTAAATCCAT | 34 | 538 |
| 1249751 | N/A | N/A | 203777 | 203796 | AACAAAGTTCCATCTCTCTA | 50 | 539 |
| 1249777 | N/A | N/A | 205850 | 205869 | TGAGAACCTGAATCTAGCCA | 53 | 540 |
| 1249803 | N/A | N/A | 207409 | 207428 | CTAAAAATCTAAATATGTTA | 96 | 541 |
| 1249829 | N/A | N/A | 208944 | 208963 | ACTCCTTTTTCAATATGTCT | 35 | 542 |
| 1249855 | N/A | N/A | 210467 | 210486 | ACTAACATTTTATAAGGTAA | 57 | 543 |
| 1249881 | N/A | N/A | 213565 | 213584 | TCTCTAGAAATACATACCCA | 41 | 544 |
| 1249907 | N/A | N/A | 216475 | 216494 | CTATTTCCCTTAACTGCATC | 48 | 545 |
| 1249933 | N/A | N/A | 222131 | 222150 | ATGAAATCAAATCTATAACA | 84 | 546 |
| 1249959 | N/A | N/A | 224981 | 225000 | TACTCTATTTACAAATGTCA | 62 | 547 |
| 1249985 | N/A | N/A | 229139 | 229158 | TCTGAATTTCCCATTAAACA | 26 | 548 |
| 1250011 | N/A | N/A | 231494 | 231513 | AAATTATATTCTAAATACAA | 80 | 549 |
| 1250037 | N/A | N/A | 234138 | 234157 | ATAACATCAATTAAATGACT | 65 | 550 |
| 1250063 | N/A | N/A | 235630 | 235649 | CCATATGGATAATACACCAA | 33 | 551 |

TABLE 8-continued

Reduction of SCN2A RNA by 5-10-5 MOE gapmers
with mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250089 | N/A | N/A | 237609 | 237628 | AATATATTCTATAATTTTCT | 91 | 552 |
| 1250115 | N/A | N/A | 241554 | 241573 | TGGCAATAGCGAATCAGTGT | 26 | 553 |
| 1250141 | N/A | N/A | 243533 | 243552 | CTTGAGATTTTAAATATTAA | 91 | 554 |
| 1250167 | N/A | N/A | 246823 | 246842 | CTTTTGTACCACCCTTCTAA | 52 | 555 |
| 1250193 | N/A | N/A | 250191 | 250210 | TAATGCTTCCTTTCTACTTA | 40 | 556 |
| 1250219 | N/A | N/A | 253267 | 253286 | TTAAAGATTTCCTCTTCTTA | 70 | 557 |
| 1250245 | N/A | N/A | 254716 | 254735 | AATGATATCATCTCATTTAA | 56 | 558 |
| 1250271 | N/A | N/A | 256711 | 256730 | GACAAACTTTTAAATTTCAC | 24 | 559 |

TABLE 9

Reduction of SCN2A RNA by 5-10-5 MOE gapmers with mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 21 | 227 |
| 1248330 | 52 | 71 | 112465 | 112484 | ACCACAGCATCCTCCCTCCT | 87 | 560 |
| 1248356 | 373 | 392 | 168918 | 168937 | TTTGGGTCTCTTAGCTTTCT | 19 | 561 |
| 1248382 | 813 | 832 | 181724 | 181743 | GTGAAATCTTCTAAACAAAA | 27 | 562 |
| 1248408 | 1521 | 1540 | 186968 | 186987 | AAGATCAAATTTATTAGATA | 96 | 563 |
| 1248434 | 2348 | 2367 | 199905 | 199924 | CTTCCAATAAATCCATGGAA | 40 | 564 |
| 1248460 | 2541 | 2560 | 204443 | 204462 | ACAAATGGGTCCATTACAAC | 71 | 565 |
| 1248486 | 3435 | 3454 | 227429 | 227448 | ATGGTGGTATGGTTGGAAAT | 22 | 566 |
| 1248512 | 3996 | 4015 | 243168 | 243187 | TCAGCATATTCTAACATGGT | 14 | 567 |
| 1248538 | 4543 | 4562 | 250607 | 250626 | CATAATATCCATCCATCCCT | 31 | 568 |
| 1248563 | 6201 | 6220 | 262729 | 262748 | GGTTTGGTCACACTATCATA | 28 | 569 |
| 1248589 | 6945 | 6964 | 263473 | 263492 | ACGAATAGCTATTTAAGCAC | 31 | 570 |
| 1248615 | 7251 | 7270 | 263779 | 263798 | TTTTGGTCAATTCAGGCTTC | 40 | 571 |
| 1248640 | 7397 | 7416 | 263925 | 263944 | CCACTGGGTAAAATTACTAT | 52 | 572 |
| 1248666 | 7519 | 7538 | 264047 | 264066 | TATAATGGAACCAATTACAT | 58 | 573 |
| 1248690 | 7824 | 7843 | 264352 | 264371 | TTTATATTTCTTAGAAAAC | 114 | 574 |
| 1248715 | 8021 | 8040 | 264549 | 264568 | TTTACAGTACTAATAAAAAA | 92 | 575 |
| 1248741 | 8356 | 8375 | 264884 | 264903 | TGCTTGTGAAACACAAAGTA | 43 | 576 |
| 1248767 | 8512 | 8531 | 265040 | 265059 | CAACAATTAAATACAAAAAC | 96 | 577 |
| 1248793 | 8654 | 8673 | 265182 | 265201 | TTAATTAACTTCCATTCCAT | 60 | 578 |
| 1248817 | 8757 | 8776 | 265285 | 265304 | TGTTAGTCAATTTTTTATTA | 91 | 579 |

TABLE 9-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248843 | N/A | N/A | 114700 | 114719 | TTCACTTTCTCATCTTTCTT | 66 | 580 |
| 1248869 | N/A | N/A | 117746 | 117765 | ACTTAACAACTTAAAACTAT | 94 | 581 |
| 1248895 | N/A | N/A | 124071 | 124090 | CACTAAAACTAAAATAGTAT | 91 | 582 |
| 1248921 | N/A | N/A | 127328 | 127347 | CTTAAATAAAACATACAACT | 90 | 583 |
| 1248946 | N/A | N/A | 128526<br>128569 | 128545<br>128588 | GCCATATTTTAATAATTGTT | 82 | 584 |
| 1248972 | N/A | N/A | 141514 | 141533 | GTATGTTTCTCCTATGCCAA | 74 | 585 |
| 1248998 | N/A | N/A | 145140 | 145159 | TTTTTACTTTCAACCTGTCT | 69 | 586 |
| 1249024 | N/A | N/A | 146284 | 146303 | AGAGATTTCACAACTTTCTT | 67 | 587 |
| 1249050 | N/A | N/A | 149569 | 149588 | TACTTTTAAAATACAACTAA | 77 | 588 |
| 1249076 | N/A | N/A | 152615 | 152634 | GGGTTACTCTAAACAGATAA | 69 | 589 |
| 1249102 | N/A | N/A | 156412 | 156431 | ATACATCTCTCCTCATATTC | 74 | 590 |
| 1249128 | N/A | N/A | 162624 | 162643 | GGTTTTCTTCCATTTGTTC | 71 | 591 |
| 1249154 | N/A | N/A | 166705 | 166724 | CTCATGCTTTTTATTTGCTA | 75 | 592 |
| 1249180 | N/A | N/A | 170593 | 170612 | CTCAAAGCTTTTAAATGCTA | 38 | 593 |
| 1249206 | N/A | N/A | 171947 | 171966 | TTCTGATCCATTCAAACTTA | 31 | 594 |
| 1249232 | N/A | N/A | 172760 | 172779 | CCAAGCATTTTTAACTTACA | 20 | 595 |
| 1249258 | N/A | N/A | 174424 | 174443 | GTTTTCCATTTTCCTACCAT | 14 | 596 |
| 1249284 | N/A | N/A | 175786 | 175805 | TGGATCATCATAACACTGGC | 19 | 597 |
| 1249310 | N/A | N/A | 176892 | 176911 | ACAAGAGAAATAATTATTTT | 90 | 598 |
| 1249336 | N/A | N/A | 177878 | 177897 | CTTTCTATTACTCTTAGGAT | 19 | 599 |
| 1249362 | N/A | N/A | 178414 | 178433 | ACAAACATAACCATTATATA | 95 | 600 |
| 1249388 | N/A | N/A | 179813 | 179832 | TTTTCTCACTCCTAATGTTT | 44 | 601 |
| 1249414 | N/A | N/A | 180595 | 180614 | TTAAAAGATTAAATGCAAA | 90 | 602 |
| 1249440 | N/A | N/A | 181595 | 181614 | GTACATATCTTAAAGATGAC | 46 | 603 |
| 1249466 | N/A | N/A | 183701 | 183720 | TATTAAATCATCTTAAATTA | 89 | 604 |
| 1249492 | N/A | N/A | 184370<br>184402 | 184389<br>184421 | TATCTAGTTTTTATTTTAA | 71 | 605 |
| 1249518 | N/A | N/A | 185489 | 185508 | ACTTTGCTAAAATATGCTAA | 50 | 606 |
| 1249544 | N/A | N/A | 186082 | 186101 | GCAAGTTACTTAACTTGCTA | 81 | 607 |
| 1249570 | N/A | N/A | 188176 | 188195 | AAGATCATAATAACATGTTC | 70 | 608 |
| 1249596 | N/A | N/A | 190485 | 190504 | ATTTAGGCAAATTTTGGCCA | 82 | 609 |
| 1249622 | N/A | N/A | 192836<br>194791 | 192855<br>194810 | CCCAGATCTCATCTTGAGTT | 28 | 610 |
| 1249648 | N/A | N/A | 200370 | 200389 | ACATTTTTAATTTATATTTC | 94 | 611 |
| 1249674 | N/A | N/A | 201016 | 201035 | CTTTCATTCTCCTTTTCTCT | 38 | 612 |
| 1249700 | N/A | N/A | 202776 | 202795 | CTAAACTCCCAAATAACCTT | 39 | 613 |

TABLE 9-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249726 | N/A | N/A | 203264 | 203283 | GTACACCCTATTACCTGTTC | 19 | 614 |
| 1249752 | N/A | N/A | 203825 | 203844 | AAGTCTCAAATTAAATTTTA | 72 | 615 |
| 1249778 | N/A | N/A | 206284 | 206303 | TACAGATCCTACATTCCTTA | 54 | 616 |
| 1249804 | N/A | N/A | 207846 | 207865 | ATAGGATTTTCTAAATACAA | 48 | 617 |
| 1249830 | N/A | N/A | 209008 | 209027 | CCTTTCCCCTAAAATTAGCC | 36 | 618 |
| 1249856 | N/A | N/A | 210650 | 210669 | TTCTTTATTTTATCTGGCCA | 44 | 619 |
| 1249882 | N/A | N/A | 213610 | 213629 | GTTCATATTTCAAAATCTAT | 26 | 620 |
| 1249908 | N/A | N/A | 216476 | 216495 | CCTATTTCCCTTAACTGCAT | 53 | 621 |
| 1249934 | N/A | N/A | 222168 | 222187 | CTTCTTCCAACATATACCAA | 42 | 622 |
| 1249960 | N/A | N/A | 225049 | 225068 | TCTTGATACACATCCATCAA | 51 | 623 |
| 1249986 | N/A | N/A | 229172 | 229191 | CTGTTATTTATACCTTCCTA | 59 | 624 |
| 1250012 | N/A | N/A | 231744 | 231763 | ATGATAAATTTAAATAATAT | 70 | 625 |
| 1250038 | N/A | N/A | 234144 | 234163 | TTCTTGATAACATCAATTAA | 65 | 626 |
| 1250064 | N/A | N/A | 235632 | 235651 | GGCCATATGGATAATACACC | 24 | 627 |
| 1250090 | N/A | N/A | 237618 | 237637 | TTGTTATTAAATATATTCTA | 88 | 628 |
| 1250116 | N/A | N/A | 241555 | 241574 | TTGGCAATAGCGAATCAGTG | 27 | 629 |
| 1250142 | N/A | N/A | 243534 | 243553 | ACTTGAGATTTTAAATATTA | 71 | 630 |
| 1250168 | N/A | N/A | 246959 | 246978 | ATCATTTTTTAAAATCCTC | 36 | 631 |
| 1250194 | N/A | N/A | 250202 | 250221 | ATTATTTATCTTAATGCTTC | 31 | 632 |
| 1250220 | N/A | N/A | 253310 | 253329 | TGCACTTTCCTTTCTAAGCA | 33 | 633 |
| 1250246 | N/A | N/A | 254960 | 254979 | CGGTCTGTTTTATATTGTCA | 20 | 634 |
| 1250272 | N/A | N/A | 256712 | 256731 | AGACAAACTTTTAAATTTCA | 55 | 635 |
| 1250297 | N/A | N/A | 259160 | 259179 | ATCTTATCTCTTAATGCTAC | 79 | 636 |

TABLE 10

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 16 | 227 |
| 1248331 | 92 | 111 | 112505 | 112524 | GCTCTATCCTCATTAAAGAA | 63 | 637 |
| 1248357 | 375 | 394 | 168920 | 168939 | TGTTTGGGTCTCTTAGCTTT | 18 | 638 |
| 1248383 | 814 | 833 | 181725 | 181744 | TGTGAAATCTTCTAAACAAA | 53 | 639 |
| 1248409 | 1605 | 1624 | 187052 | 187071 | ATCTGCTGAAATTCAGCTTC | 44 | 640 |
| 1248435 | 2352 | 2371 | 199909 | 199928 | GGATCTTCCAATAAATCCAT | 42 | 641 |
| 1248461 | 2604 | 2623 | 204506 | 204525 | GGATAGTGCTCCATAGCCAT | 11 | 642 |

TABLE 10-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248487 | 3516 | 3535 | 227510 | 227529 | ACATATTTTCTACACTGCT | 15 | 643 |
| 1248513 | 3999 | 4018 | 243171 | 243190 | TTGTCAGCATATTCTAACAT | 39 | 644 |
| 1248539 | 4544 | 4563 | 250608 | 250627 | ACATAATATCCATCCATCCC | 39 | 645 |
| 1248564 | 6226 | 6245 | 262754 | 262773 | GTCTTTTTCAAATTTTTCTT | 39 | 646 |
| 1248590 | 6960 | 6979 | 263488 | 263507 | AGACACCTTAAAAATACGAA | 41 | 647 |
| 1248616 | 7253 | 7272 | 263781 | 263800 | TTTTTTGGTCAATTCAGGCT | 27 | 648 |
| 1248641 | 7414 | 7433 | 263942 | 263961 | GTTTGCTCAAACATGCACCA | 52 | 649 |
| 1248667 | 7526 | 7545 | 264054 | 264073 | TTCAAACTATAATGGAACCA | 39 | 650 |
| 1248691 | 7827 | 7846 | 264355 | 264374 | GTATTTATATTTCTTAGAA | 79 | 651 |
| 1248716 | 8022 | 8041 | 264550 | 264569 | GTTACAGTACTAATAAAAA | 77 | 652 |
| 1248742 | 8375 | 8394 | 264903 | 264922 | AAGAATCTACATTTATTGTT | 64 | 653 |
| 1248768 | 8513 | 8532 | 265041 | 265060 | ACAACAATTAAATACAAAAA | 77 | 654 |
| 1248794 | 8655 | 8674 | 265183 | 265202 | CTTAATTAACTTCCATTCCA | 59 | 655 |
| 1248818 | N/A | N/A | 166899 | 166918 | GGCATTATTGTAACTACCAC | 68 | 656 |
| 1248844 | N/A | N/A | 114822 | 114841 | ATCCTCCTAAAATCTTTTCC | 74 | 657 |
| 1248870 | N/A | N/A | 117753 | 117772 | GCAAAAGACTTAACAACTTA | 60 | 658 |
| 1248896 | N/A | N/A | 124079 | 124098 | AACATTGTCACTAAAACTAA | 71 | 659 |
| 1248922 | N/A | N/A | 127515 | 127534 | ATATTGATATTATCTAGAAA | 106 | 660 |
| 1248947 | N/A | N/A | 128527 128570 | 128546 128589 | AGCCATATTTTAATAATTGT | 56 | 661 |
| 1248973 | N/A | N/A | 141858 | 141877 | TTTTACTCAACCTAATGTCC | 88 | 662 |
| 1248999 | N/A | N/A | 145147 | 145166 | ACTGATTTTTTACTTTCAA | 82 | 663 |
| 1249025 | N/A | N/A | 146336 | 146355 | TAAGGATTAAACTAAAATCA | 96 | 664 |
| 1249051 | N/A | N/A | 149572 | 149591 | GCTTACTTTTAAAATACAAC | 76 | 665 |
| 1249077 | N/A | N/A | 152630 | 152649 | TTATTATAATTAACTGGGTT | 101 | 666 |
| 1249103 | N/A | N/A | 156668 | 156687 | TGGATCCCTTTCTATACCTA | 77 | 667 |
| 1249129 | N/A | N/A | 162671 | 162690 | AGTCTGTTTCTCATTTCCCA | 65 | 668 |
| 1249155 | N/A | N/A | 167626 | 167645 | CTTTTCAAAAAATCAATCTA | 76 | 669 |
| 1249181 | N/A | N/A | 170745 | 170764 | ACTTCAATAAAACATAGGAA | 38 | 670 |
| 1249207 | N/A | N/A | 171986 | 172005 | CTCCATCTCATCATTCAGAT | 19 | 671 |
| 1249233 | N/A | N/A | 172820 | 172839 | CTAGTGGTAATAAATATACA | 35 | 672 |
| 1249259 | N/A | N/A | 174427 | 174446 | TATGTTTTCCATTTTCCTAC | 39 | 673 |
| 1249285 | N/A | N/A | 175789 | 175808 | GCCTGGATCATCATAACACT | 22 | 674 |
| 1249311 | N/A | N/A | 176908 | 176927 | ATATATTTCAACATTAACAA | 59 | 675 |
| 1249337 | N/A | N/A | 177882 | 177901 | GTAGCTTTCTATTACTCTTA | 9 | 676 |
| 1249363 | N/A | N/A | 178420 | 178439 | TGCTCAACAAACATAACCAT | 41 | 677 |

TABLE 10-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249389 | N/A | N/A | 179820 | 179839 | TCATATCTTTTCTCACTCCT | 38 | 678 |
| 1249415 | N/A | N/A | 180640 | 180659 | GCCAAGCCATCAACTATTTT | 35 | 679 |
| 1249441 | N/A | N/A | 181611 | 181630 | AGTGGTTAATTTACAAGTAC | 55 | 680 |
| 1249467 | N/A | N/A | 183705 | 183724 | TATGTATTAAATCATCTTAA | 50 | 681 |
| 1249493 | N/A | N/A | 184519 | 184538 | ATTTATTCCCTCTTATGATA | 53 | 682 |
| 1249519 | N/A | N/A | 185499 | 185518 | GTTTGTAACCACTTTGCTAA | 36 | 683 |
| 1249545 | N/A | N/A | 186349 | 186368 | AAGCAATCATATCATGATTA | 37 | 684 |
| 1249571 | N/A | N/A | 188217 | 188236 | CTATGATATCTAATTATCTA | 61 | 685 |
| 1249597 | N/A | N/A | 190580 | 190599 | TAGTTTTATTCAATTAGAAA | 82 | 686 |
| 1249623 | N/A | N/A | 192837 194792 | 192856 194811 | ACCCAGATCTCATCTTGAGT | 37 | 687 |
| 1249649 | N/A | N/A | 200374 | 200393 | ATTCACATTTTTAATTTATA | 82 | 688 |
| 1249675 | N/A | N/A | 201589 | 201608 | AGTAATGTCTTATTTAGCTC | 17 | 689 |
| 1249701 | N/A | N/A | 202784 | 202803 | AAATACTTCTAAACTCCCAA | 40 | 690 |
| 1249727 | N/A | N/A | 203333 | 203352 | ATAATCTCTTCATCAACTTA | 56 | 691 |
| 1249753 | N/A | N/A | 203874 | 203893 | GTGATCTTCTAATTAGATAA | 25 | 692 |
| 1249779 | N/A | N/A | 206308 | 206327 | TACTATTCCATAATTCACCT | 45 | 693 |
| 1249805 | N/A | N/A | 207897 | 207916 | GCAATCTTATTTATTAGTTC | 24 | 694 |
| 1249831 | N/A | N/A | 209009 | 209028 | GCCTTTCCCCTAAAATTAGC | 28 | 695 |
| 1249857 | N/A | N/A | 210729 | 210748 | TTTGTTTATCTTAAAATTCT | 49 | 696 |
| 1249883 | N/A | N/A | 213626 | 213645 | TTACATTTTTATAATAGTTC | 82 | 697 |
| 1249909 | N/A | N/A | 216559 | 216578 | ACCAAAGTATTTAATTTATT | 84 | 698 |
| 1249935 | N/A | N/A | 222169 | 222188 | TCTTCTTCCAACATATACCA | 42 | 699 |
| 1249961 | N/A | N/A | 225181 | 225200 | TGGATTAAAAAAACAGACAA | 57 | 700 |
| 1249987 | N/A | N/A | 229264 | 229283 | ATTAAAGTAATTCTTTGCCC | 26 | 701 |
| 1250013 | N/A | N/A | 231745 | 231764 | CATGATAAATTTAAATAATA | 95 | 702 |
| 1250039 | N/A | N/A | 234163 | 234182 | ATTCTGATTTATAAACCCT | 30 | 703 |
| 1250065 | N/A | N/A | 235633 | 235652 | AGGCCATATGGATAATACAC | 21 | 704 |
| 1250091 | N/A | N/A | 237640 | 237659 | TGACATGAAAACATATACCA | 56 | 705 |
| 1250117 | N/A | N/A | 241556 | 241575 | GTTGGCAATAGCGAATCAGT | 22 | 706 |
| 1250143 | N/A | N/A | 243555 | 243574 | ATTCATATTTTATTTTGCAT | 40 | 707 |
| 1250169 | N/A | N/A | 246960 | 246979 | TATCATTTTTTAAAATCCT | 78 | 708 |
| 1250195 | N/A | N/A | 250330 | 250349 | ATGCTATCATAAAAACAATA | 40 | 709 |
| 1250221 | N/A | N/A | 253346 | 253365 | TAGACAATTTCACCCAACAA | 91 | 710 |
| 1250247 | N/A | N/A | 255011 | 255030 | TATCCATTTCTTTGAGTTA | 61 | 711 |

TABLE 10-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250273 | N/A | N/A | 256737 | 256756 | TCTTTAGTTCCCATATTCAA | 60 | 712 |
| 1250298 | N/A | N/A | 259161 | 259180 | AATCTTATCTCTTAATGCTA | 70 | 713 |

TABLE 11

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910059 | 7528 | 7547 | 264056 | 264075 | GCTTCAAACTATAATGGAAC | 35 | 193 |
| 910263 | N/A | N/A | 180777 | 180796 | GCACTACCATGCCTTCACCA | 18 | 227 |
| 1248332 | 96 | 115 | 112509 | 112528 | ATGTGCTCTATCCTCATTAA | 70 | 714 |
| 1248358 | 376 | 395 | 168921 | 168940 | CTGTTTGGGTCTCTTAGCTT | 24 | 715 |
| 1248384 | 815 | 834 | 181726 | 181745 | ATGTGAAATCTTCTAAACAA | 60 | 716 |
| 1248410 | 1608 | 1627 | 187055 | 187074 | AGCATCTGCTGAAATTCAGC | 32 | 717 |
| 1248436 | 2353 | 2372 | 199910 | 199929 | AGGATCTTCCAATAAATCCA | 46 | 718 |
| 1248462 | 2605 | 2624 | 204507 | 204526 | GGGATAGTGCTCCATAGCCA | 12 | 719 |
| 1248488 | 3517 | 3536 | 227511 | 227530 | GACATATTTTCTACACTGC | 25 | 720 |
| 1248514 | 4002 | 4021 | 243174 | 243193 | ACCTTGTCAGCATATTCTAA | 44 | 721 |
| 1248540 | 4545 | 4564 | 250609 | 250628 | TACATAATATCCATCCATCC | 49 | 722 |
| 1248565 | 6230 | 6249 | 262758 | 262777 | ATTTGTCTTTTTCAAATTTT | 88 | 723 |
| 1248591 | 6984 | 7003 | 263512 | 263531 | GGCACATTAAATTTTTTCTG | 57 | 724 |
| 1248617 | 7282 | 7301 | 263810 | 263829 | ATCAACTTTATAAAGTGGTG | 35 | 725 |
| 1248642 | 7417 | 7436 | 263945 | 263964 | TTTGTTTGCTCAAACATGCA | 70 | 726 |
| 1248692 | 7830 | 7849 | 264358 | 264377 | ACAGTATTTATATTTTCTTA | 46 | 727 |
| 1248717 | 8028 | 8047 | 264556 | 264575 | GTGCAAGTTTACAGTACTAA | 25 | 728 |
| 1248743 | 8376 | 8395 | 264904 | 264923 | AAAGAATCTACATTTATTGT | 78 | 729 |
| 1248769 | 8515 | 8534 | 265043 | 265062 | AGACAACAATTAAATACAAA | 77 | 730 |
| 1248795 | 8656 | 8675 | 265184 | 265203 | TCTTAATTAACTTCCATTCC | 75 | 731 |
| 1248819 | V/A | N/A | 166998 | 167017 | TTTTTTTAATTCTCCTTCAA | 76 | 732 |
| 1248845 | N/A | N/A | 114826 | 114845 | TCACATCCTCCTAAAATCTT | 92 | 733 |
| 1248871 | N/A | N/A | 117846 | 117865 | ACACAATCACATAATTGTAT | 64 | 734 |
| 1248897 | N/A | N/A | 124805 | 124824 | ATTATATTAATCAAAGTCTT | 69 | 735 |
| 1248923 | N/A | N/A | 127539 | 127558 | GAGTTTTATTTTCTAGCAA | 78 | 736 |
| 1248948 | N/A | N/A | 128528 128571 | 128547 128590 | GAGCCATATTTTAATAATTG | 63 | 737 |
| 1248974 | N/A | N/A | 141865 | 141884 | TGGCTTATTTTACTCAACCT | 64 | 738 |

TABLE 11-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249000 | N/A | N/A | 145209 | 145228 | TTTTGATATTCATATAGCCA | 101 | 739 |
| 1249026 | N/A | N/A | 146347 | 146366 | CTTATATTCATTAAGGATTA | 71 | 740 |
| 1249052 | N/A | | 149573 | 149592 | GGCTTACTTTTAAAATACAA | 82 | 741 |
| 1249078 | N/A | N/A | 152644 | 152663 | GCAGATTCAATATTTTATTA | 76 | 742 |
| 1249104 | N/A | N/A | 156786 | 156805 | CTGATTTCAAATACTAAATA | 74 | 743 |
| 1249130 | N/A | N/A | 162724 | 162743 | TTTTTTCACATCAAAGATAC | 94 | 744 |
| 1249156 | N/A | N/A | 167638 | 167657 | TATTTTTTCCATCTTTTCAA | 58 | 745 |
| 1249182 | N/A | N/A | 170920 | 170939 | ACTACTCTATTTAATTTCAA | 66 | 746 |
| 1249208 | N/A | N/A | 171999 | 172018 | TGGGTTTTCTTAACTCCATC | 27 | 747 |
| 1249234 | N/A | N/A | 172873 | 172892 | AAGTTTAAAATAAAAACTTA | 82 | 748 |
| 1249260 | N/A | N/A | 174428 | 174447 | CTATGTTTTCCATTTTCCTA | 44 | 749 |
| 1249286 | N/A | N/A | 175950 | 175969 | CTATTAATTTCTTTATGCCA | 20 | 750 |
| 1249312 | V/A | | 176946 | 176965 | ATAGTGGTATAATTTAGTTA | 32 | 751 |
| 1249338 | N/A | N/A | 177884 | 177903 | TGGTAGCTTTCTATTACTCT | 13 | 752 |
| 1249364 | N/A | N/A | 178424 | 178443 | ACATTGCTCAACAAACATAA | 61 | 753 |
| 1249390 | N/A | N/A | 179827 | 179846 | GTGCTCTTCATATCTTTTCT | 9 | 754 |
| 1249416 | N/A | N/A | 180670 | 180689 | AGCAACCTCATATTTAGATC | 12 | 755 |
| 1249442 | N/A | N/A | 181630 | 181649 | AAGCTCACATTAAAAATCTA | 89 | 756 |
| 1249468 | N/A | N/A | 183768 | 183787 | CTTTTACTATATCAATGGAC | 29 | 757 |
| 1249494 | N/A | N/A | 184520 | 184539 | TATTTATTCCCTCTTATGAT | 73 | 758 |
| 1249520 | N/A | N/A | 185598 | 185617 | ATTATTATACCCATTTGTCA | 46 | 759 |
| 1249546 | N/A | N/A | 186363 | 186382 | ATGTCTCCATATAAAAGCAA | 45 | 760 |
| 1249572 | N/A | N/A | 188762 | 188781 | TTCATGTAATTTAATATTTT | 77 | 761 |
| 1249598 | N/A | N/A | 190665 | 190684 | GAGAATATCATATCTATGAA | 21 | 762 |
| 1249624 | N/A | N/A | 194838 | 194857 | ATCTAGGTTTTTATATGCCT | 55 | 763 |
| 1249650 | N/A | N/A | 200387 | 200406 | ATATCAAACCCTAATTCACA | 68 | 764 |
| 1249676 | N/A | N/A | 201648 | 201667 | TGAACTCCAAATCTTAATTA | 38 | 765 |
| 1249702 | V/A | N/A | 202810 | 202829 | TAGTTATTATGCACTAGTTA | 39 | 766 |
| 1249728 | N/A | N/A | 203338 | 203357 | GCAAGATAATCTCTTCATCA | 22 | 767 |
| 1249754 | N/A | N/A | 203875 | 203894 | GGTGATCTTCTAATTAGATA | 23 | 768 |
| 1249780 | N/A | N/A | 206311 | 206330 | TTCTACTATTCCATAATTCA | 64 | 769 |
| 1249806 | N/A | N/A | 207901 | 207920 | TTCTGCAATCTTATTTATTA | 39 | 770 |
| 1249832 | N/A | N/A | 209105 | 209124 | TTTTTCCACATCCTTGATAA | 56 | 771 |
| 1249858 | N/A | N/A | 210809 | 210828 | ATATTTTTCCTATTCGGCCT | 48 | 772 |
| 1249884 | N/A | N/A | 213650 | 213669 | CTTTAGTTTTCCTTTTATAA | 62 | 773 |
| 1249910 | N/A | N/A | 216608 | 216627 | AGTGCATTATTTAATGGCAT | 64 | 774 |

TABLE 11-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249936 | N/A | N/A | 222244 | 222263 | TTATATTTCTTAATTCCCCA | 47 | 775 |
| 1249962 | N/A | N/A | 225297 | 225316 | GTCAGTCTCTATACTATGAC | 60 | 776 |
| 1249988 | N/A | N/A | 229313 | 229332 | ATTCAACTTTCAAACAATAA | 56 | 777 |
| 1250014 | N/A | N/A | 231811 | 231830 | CTTCATTTTAAAAACACCCT | 52 | 778 |
| 1250040 | N/A | N/A | 234397 | 234416 | TTTATCAATTTAAAACATTT | 74 | 779 |
| 1250066 | N/A | N/A | 235634 | 235653 | TAGGCCATATGGATAATACA | 35 | 780 |
| 1250092 | N/A | N/A | 237671 | 237690 | CAGCAACCATCTAAATTTAT | 44 | 781 |
| 1250118 | N/A | N/A | 241558 | 241577 | TGGTTGGCAATAGCGAATCA | 54 | 782 |
| 1250144 | N/A | N/A | 243569 | 243588 | AGCAAAATTTCTAAATTCAT | 67 | 783 |
| 1250170 | N/A | N/A | 246986 | 247005 | AACTTATTTTCAAATATCAC | 56 | 784 |
| 1250196 | N/A | N/A | 250400 | 250419 | TTATATTCCTCTATAACATC | 61 | 785 |
| 1250222 | N/A | N/A | 253512 | 253531 | AGTGAGTTTTAATTATCTA | 40 | 786 |
| 1250248 | N/A | N/A | 255029 | 255048 | TGTTTGACCCAATATAGCTA | 43 | 787 |
| 1250274 | N/A | N/A | 256849 | 256868 | TAGCATCTCCAATTTTCTCA | 50 | 788 |
| 1250299 | N/A | N/A | 259495 | 259514 | CAGATCTCAAATCTTATCTC | 39 | 789 |

TABLE 12

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 23 | 227 |
| 1248333 | 97 | 116 | 112510 | 112529 | CATGTGCTCTATCCTCATTA | 57 | 790 |
| 1248359 | 377 | 396 | 168922 | 168941 | CCTGTTTGGGTCTCTTAGCT | 25 | 791 |
| 1248385 | 946 | 965 | 182414 | 182433 | TGAAATTGTTTTCAATGCTC | 17 | 792 |
| 1248411 | 1630 | 1649 | 187077 | 187096 | TTGTTGCTTTTTCAACTGTT | 58 | 793 |
| 1248437 | 2354 | 2373 | 199911 | 199930 | TAGGATCTTCCAATAAATCC | 47 | 794 |
| 1248463 | 2646 | 2665 | 204548 | 204567 | AGGTTTCCAACAGACAGTAC | 56 | 795 |
| 1248489 | 3535 | 3554 | 227529 | 227548 | GTAATCACTTTCATCCACGA | 18 | 796 |
| 1248515 | 4013 | 4032 | 243185 | 243204 | TGTAAGTGAAAACCTTGTCA | 32 | 797 |
| 1248541 | 4547 | 4566 | 250611 | 250630 | CATACATAATATCCATCCAT | 38 | 798 |
| 1248566 | 6248 | 6267 | 262776 | 262795 | CTTTGTCTTCCTTTTCTGAT | 57 | 799 |
| 1248592 | 6998 | 7017 | 263526 | 263545 | ATGGAACATTTACAGGCACA | 32 | 800 |
| 1248618 | 7283 | 7302 | 263811 | 263830 | AATCAACTTTATAAAGTGGT | 49 | 801 |
| 1248643 | 7418 | 7437 | 263946 | 263965 | TTTTGTTTGCTCAAACATGC | 74 | 802 |

TABLE 12-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248668 | 7529 | 7548 | 264057 | 264076 | AGCTTCAAACTATAATGGAA | 28 | 803 |
| 1248693 | 7832 | 7851 | 264360 | 264379 | TTACAGTATTTATATTTCT | 71 | 804 |
| 1248718 | 8029 | 8048 | 264557 | 264576 | TGTGCAAGTTTACAGTACTA | 26 | 805 |
| 1248744 | 8379 | 8398 | 264907 | 264926 | TATAAAGAATCTACATTTAT | 100 | 806 |
| 1248770 | 8516 | 8535 | 265044 | 265063 | AAGACAACAATTAAATACAA | 69 | 807 |
| 1248796 | 8659 | 8678 | 265187 | 265206 | TCTTCTTAATTAACTTCCAT | 71 | 808 |
| 1248820 | N/A | N/A | 166999 | 167018 | TTTTTTTTAATTCTCCTTCA | 106 | 809 |
| 1248846 | N/A | N/A | 114827 | 114846 | GTCACATCCTCCTAAAATCT | 67 | 810 |
| 1248872 | N/A | N/A | 117883 | 117902 | ATACATATCACACAACACAA | 72 | 811 |
| 1248898 | N/A | N/A | 124812 | 124831 | GTTAGCTATTATATTAATCA | 60 | 812 |
| 1248924 | N/A | N/A | 127954 | 127973 | ATATCAACAAATACAAACAA | 81 | 813 |
| 1248949 | N/A | N/A | 128769 | 128788 | ACTGAAATTATCATTATTAC | 70 | 814 |
| 1248975 | N/A | N/A | 141917 | 141936 | TTTTTAGATTCCATACCTAA | 70 | 815 |
| 1249001 | N/A | N/A | 145228 | 145247 | TTTGTCTTAAAATCTACTTT | 74 | 816 |
| 1249027 | N/A | N/A | 146354 | 146373 | CAGGCTTCTTATATTCATTA | 68 | 817 |
| 1249053 | N/A | N/A | 149574 | 149593 | TGGCTTACTTTTAAAATACA | 76 | 818 |
| 1249079 | N/A | N/A | 152647 | 152666 | CATGCAGATTCAATATTTTA | 93 | 819 |
| 1249105 | N/A | N/A | 156789 | 156808 | TGTCTGATTTCAAATACTAA | 79 | 820 |
| 1249131 | N/A | N/A | 162726 | 162745 | TATTTTTTCACATCAAAGAT | 89 | 821 |
| 1249157 | N/A | N/A | 167676 | 167695 | ATACAATCAACATCTTGACT | 56 | 822 |
| 1249183 | N/A | N/A | 170921 | 170940 | AACTACTCTATTTAATTTCA | 71 | 823 |
| 1249209 | N/A | N/A | 172046 | 172065 | ACAAAAGTTTTAAAACAAAA | 85 | 824 |
| 1249235 | N/A | N/A | 172947 | 172966 | ACAATAGCTCCTAATAGATA | 58 | 825 |
| 1249261 | N/A | N/A | 174429 | 174448 | CCTATGTTTTCCATTTTCCT | 34 | 826 |
| 1249287 | N/A | N/A | 175957 | 175976 | TTTTAATCTATTAATTTCTT | 86 | 827 |
| 1249313 | N/A | N/A | 176957 | 176976 | ACTTACTCTTTATAGTGGTA | 11 | 828 |
| 1249339 | N/A | N/A | 177944 | 177963 | ATTTAATCCATTCTGCATAC | 46 | 829 |
| 1249365 | N/A | N/A | 178434 | 178453 | CCATCAACAAACATTGCTCA | 43 | 830 |
| 1249391 | N/A | N/A | 179935 | 179954 | TCATATTTAATAAAAAGCAT | 78 | 831 |
| 1249417 | N/A | N/A | 180686 | 180705 | GCCATTTCTATAACTCAGCA | 8 | 832 |
| 1249443 | N/A | N/A | 181633 | 181652 | GCCAAGCTCACATTAAAAAT | 46 | 833 |
| 1249469 | N/A | N/A | 183769 | 183788 | ACTTTTACTATATCAATGGA | 42 | 834 |
| 1249495 | N/A | N/A | 184524 | 184543 | TAGGTATTTATTCCCTCTTA | 17 | 835 |
| 1249521 | N/A | N/A | 185614 | 185633 | TCATCACAAAAACCCTATTA | 54 | 836 |

TABLE 12-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249547 | N/A | N/A | 186364 | 186383 | TATGTCTCCATATAAAAGCA | 58 | 837 |
| 1249573 | N/A | N/A | 189437 | 189456 | TCTAAATTTTAAAATTTCAA | 79 | 838 |
| 1249599 | N/A | N/A | 190734 | 190753 | GTGATTGCTTATAATACCCA | 21 | 839 |
| 1249625 | N/A | N/A | 194853 | 194872 | TTTATACCTACTAATATCTA | 75 | 840 |
| 1249651 | N/A | N/A | 200390 | 200409 | TTAATATCAAACCCTAATTC | 71 | 841 |
| 1249677 | N/A | N/A | 201663 | 201682 | TGGGTGCATTTATTTTGAAC | 23 | 842 |
| 1249703 | N/A | N/A | 202851 | 202870 | AAACAATAAATAATATTTGA | 78 | 843 |
| 1249729 | N/A | N/A | 203339 | 203358 | GGCAAGATAATCTCTTCATC | 14 | 844 |
| 1249755 | N/A | N/A | 203876 | 203895 | TGGTGATCTTCTAATTAGAT | 22 | 845 |
| 1249781 | N/A | N/A | 206319 | 206338 | TATGGATTTTCTACTATTCC | 58 | 846 |
| 1249807 | N/A | N/A | 207983 | 208002 | ATAGAATTTTCCTAATTTTA | 76 | 847 |
| 1249833 | N/A | N/A | 209119 | 209138 | CATAACCATTCTAATTTTTC | 53 | 848 |
| 1249859 | N/A | N/A | 210859 | 210878 | CATTTATTCATATCTAGTGA | 60 | 849 |
| 1249885 | N/A | N/A | 213718 | 213737 | TTTTCTTCCTCTAACAAATC | 77 | 850 |
| 1249911 | N/A | N/A | 216782 | 216801 | TTCTTTTTAACCTTTATATC | 71 | 851 |
| 1249937 | N/A | N/A | 222245 | 222264 | CTTATATTTCTTAATTCCCC | 77 | 852 |
| 1249963 | N/A | N/A | 225443 | 225462 | TCATGCTTCTATCATGCTAA | 24 | 853 |
| 1249989 | N/A | N/A | 229453 | 229472 | TTCTATTTTATAAATGCCGA | 27 | 854 |
| 1250015 | N/A | N/A | 231813 | 231832 | CTCTTCATTTTAAAAACACC | 25 | 855 |
| 1250041 | N/A | N/A | 234398 | 234417 | GTTTATCAATTTAAAACATT | 81 | 856 |
| 1250067 | N/A | N/A | 235636 | 235655 | TCTAGGCCATATGGATAATA | 37 | 857 |
| 1250093 | N/A | N/A | 237672 | 237691 | ACAGCAACCATCTAAATTTA | 71 | 858 |
| 1250119 | N/A | N/A | 241579 | 241598 | TCTACTTCTTATCATTCACT | 20 | 859 |
| 1250145 | N/A | N/A | 243715 | 243734 | TTTGGACTTTCAAATTTCTT | 40 | 860 |
| 1250171 | N/A | N/A | 246987 | 247006 | CAACTTATTTTCAAATATCA | 56 | 861 |
| 1250197 | N/A | N/A | 250401 | 250420 | TTTATATTCCTCTATAACAT | 36 | 862 |
| 1250223 | N/A | N/A | 253875 | 253894 | ATCTGAATTATTAATTGCTT | 40 | 863 |
| 1250249 | N/A | N/A | 255071 | 255090 | GTATTATTCCTAAAGACTA | 73 | 864 |
| 1250275 | N/A | N/A | 256949 | 256968 | AAGAAACCTTTATTTTGCTA | 78 | 865 |
| 1250300 | N/A | N/A | 259521 260898 | 259540 260917 | GTAGTGTAAATAGGGAAGCT | 31 | 866 |

TABLE 13

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 15 | 227 |
| 1248334 | 99 | 118 | 112512 | 112531 | CACATGTGCTCTATCCTCAT | 59 | 867 |
| 1248360 | 379 | 398 | 168924 | 168943 | TTCCTGTTTGGGTCTCTTAG | 29 | 868 |
| 1248386 | 1007 | 1026 | 183354 | 183373 | CAGAAAGCTTCTTCACTGAC | 48 | 869 |
| 1248412 | 1711 | 1730 | 188520 | 188539 | TGAAAAACTCCTATCCCAC | 39 | 870 |
| 1248438 | 2355 | 2374 | 199912 | 199931 | GTAGGATCTTCCAATAAATC | 28 | 871 |
| 1248464 | 2719 | 2738 | 215348 | 215367 | TTGAAAGTAATAATATGGAT | 77 | 872 |
| 1248490 | 3678 | 3697 | 238143 | 238162 | GAACTAGTTGCATTTAGCTT | 25 | 873 |
| 1248516 | 4033 | 4052 | 243205 | 243224 | CAGCATTTCCAGAATGAATA | 32 | 874 |
| 1248542 | 4597 | 4616 | 253602 | 253621 | GTTGTCTTCATACTTGGGTT | 24 | 875 |
| 1248567 | 6249 | 6268 | 262777 | 262796 | CCTTTGTCTTCCTTTTCTGA | 45 | 876 |
| 1248593 | 7010 | 7029 | 263538 | 263557 | GCTTGTGATTCTATGGAACA | 19 | 877 |
| 1248619 | 7288 | 7307 | 263816 | 263835 | AGCAGAATCAACTTTATAAA | 52 | 878 |
| 1248644 | 7430 | 7449 | 263958 | 263977 | TTAAATCATCATTTTGTTT | 81 | 879 |
| 1248669 | 7530 | 7549 | 264058 | 264077 | CAGCTTCAAACTATAATGGA | 34 | 880 |
| 1248694 | 7833 | 7852 | 264361 | 264380 | TTTACAGTATTTATATTTTC | 71 | 881 |
| 1248719 | 8092 | 8111 | 264620 | 264639 | GGCATTACTATTGAAAGCAA | 51 | 882 |
| 1248745 | 8380 | 8399 | 264908 | 264927 | GTATAAAGAATCTACATTTA | 73 | 883 |
| 1248771 | 8518 | 8537 | 265046 | 265065 | CAAAGACAACAATTAAATAC | 73 | 884 |
| 1248797 | 8660 | 8679 | 265188 | 265207 | CTCTTCTTAATTAACTTCCA | 45 | 885 |
| 1248821 | N/A | N/A | 112682 | 112701 | GTCATTCTTAACATAGATAA | 61 | 886 |
| 1248847 | N/A | N/A | 114843 | 114862 | AAGATCTAATTTAACTGTCA | 61 | 887 |
| 1248873 | N/A | N/A | 117895 | 117914 | TGTCATTTCCCCATACATAT | 79 | 888 |
| 1248899 | N/A | N/A | 124922 | 124941 | AAATTTAGTCATAATAGTAC | 79 | 889 |
| 1248925 | N/A | N/A | 127957 | 127976 | AATATATCAACAAATACAAA | 86 | 890 |
| 1248950 | N/A | N/A | 129692 | 129711 | GAGGACACTTTAATTATGAA | 61 | 891 |
| 1248976 | N/A | N/A | 141941 249003 | 141960 249022 | CTTTCTGTTTCTGTGAGTTT | 23 | 892 |
| 1249002 | N/A | N/A | 145254 | 145273 | GACCATTTTTATCTGTGTTA | 76 | 893 |
| 1249028 | N/A | N/A | 146355 | 146374 | TCAGGCTTCTTATATTCATT | 57 | 894 |
| 1249054 | N/A | N/A | 150098 | 150117 | ACATTATCTTTTACTAAGTA | 75 | 895 |
| 1249080 | N/A | N/A | 152667 | 152686 | CCTTCTCATTCCATTGCCAA | 72 | 896 |
| 1249106 | N/A | N/A | 157633 | 157652 | TTCTTCTTTTCATCAAAGAC | 57 | 897 |
| 1249132 | N/A | N/A | 162865 | 162884 | CCTTAACATTATATTAGTTA | 70 | 898 |
| 1249158 | N/A | N/A | 167737 | 167756 | ATCAGTCATTCCAAATGTTA | 39 | 899 |
| 1249184 | N/A | N/A | 170939 | 170958 | ATAAAATCTCTCATTTCCAA | 52 | 900 |
| 1249210 | N/A | N/A | 172185 | 172204 | CAGAATTTCTTAAACTGCCC | 21 | 901 |

TABLE 13-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249236 | N/A | N/A | 172956 | 172975 | ATTTGATACACAATAGCTCC | 26 | 902 |
| 1249262 | N/A | N/A | 174579 | 174598 | TTTATCATTATTAATGTCTA | 48 | 903 |
| 1249288 | N/A | N/A | 175963 | 175982 | GATGTTTTTAATCTATTAA | 62 | 904 |
| 1249314 | N/A | N/A | 176965 | 176984 | ACTTAAAAACTTACTCTTTA | 49 | 905 |
| 1249340 | N/A | N/A | 177947 | 177966 | TCCATTTAATCCATTCTGCA | 23 | 906 |
| 1249366 | N/A | N/A | 178461 | 178480 | CTTCTACTCTCCTCATCCTA | 43 | 907 |
| 1249392 | N/A | N/A | 179936 | 179955 | TTCATATTTAATAAAAAGCA | 64 | 908 |
| 1249418 | N/A | N/A | 180689 | 180708 | TTTGCCATTTCTATAACTCA | 14 | 909 |
| 1249444 | N/A | N/A | 181938 | 181957 | TGATAGTTCCTAATTTCTCC | 17 | 910 |
| 1249470 | N/A | N/A | 183774 | 183793 | TGAGAACTTTTACTATATCA | 18 | 911 |
| 1249496 | N/A | N/A | 184558 | 184577 | CAATTTTAACTTAATTTCCT | 53 | 912 |
| 1249522 | N/A | N/A | 185619 | 185638 | CTTCATCATCACAAAAACCC | 47 | 913 |
| 1249548 | N/A | N/A | 186387 | 186406 | ATAATTGTCATTATTATATT | 70 | 914 |
| 1249574 | N/A | N/A | 189438 | 189457 | TTCTAAATTTTAAAATTTCA | 91 | 915 |
| 1249600 | N/A | N/A | 190808 | 190827 | ACTCTATTTTATATAGAGA | 76 | 916 |
| 1249626 | N/A | N/A | 194860 | 194879 | CCATTATTTTATACCTACTA | 33 | 917 |
| 1249652 | N/A | N/A | 200393 | 200412 | AAGTTAATATCAAACCCTAA | 58 | 918 |
| 1249678 | N/A | N/A | 201716 | 201735 | CATCCTTTCCATCCTAAGCA | 48 | 919 |
| 1249704 | N/A | N/A | 202855 | 202874 | TTGTAAACAATAAATAATAT | 101 | 920 |
| 1249730 | N/A | N/A | 203354 | 203373 | CTACCATCTTCCTTTGGCAA | 33 | 921 |
| 1249756 | N/A | N/A | 203930 | 203949 | CTAAGAACCTTAATCAGTCA | 45 | 922 |
| 1249782 | N/A | N/A | 206363 | 206382 | TAGGGAATATCCTATAGGCA | 32 | 923 |
| 1249808 | N/A | N/A | 208114 | 208133 | AATGTGCTTTCATTTATTTA | 35 | 924 |
| 1249834 | N/A | N/A | 209260 | 209279 | GTTTTTAATTCTCTTAGATA | 27 | 925 |
| 1249860 | N/A | N/A | 210869 | 210888 | TATTTACCCACATTTATTCA | 65 | 926 |
| 1249886 | N/A | N/A | 213719 | 213738 | ATTTTCTTCCTCTAACAAAT | 71 | 927 |
| 1249912 | N/A | N/A | 216786 | 216805 | AGGCTTCTTTTTAACCTTTA | 22 | 928 |
| 1249938 | N/A | N/A | 222278 | 222297 | CATAAATTAAATTCTACCCA | 70 | 929 |
| 1249964 | N/A | N/A | 225468 | 225487 | AGGATTCTACATTCTTGCTA | 54 | 930 |
| 1249990 | N/A | N/A | 229454 | 229473 | ATTCTATTTTATAAATGCCG | 23 | 931 |
| 1250016 | N/A | N/A | 231814 | 231833 | TCTCTTCATTTTAAAAACAC | 43 | 932 |
| 1250042 | N/A | N/A | 234546 | 234565 | ATCCAGTATTTATTTAGAGA | 28 | 933 |
| 1250068 | N/A | N/A | 235802 | 235821 | GCTTATCACACATCTTGAAC | 34 | 934 |
| 1250094 | N/A | N/A | 237763 | 237782 | GTTTTATTCTAAAATTGTGA | 46 | 935 |
| 1250120 | N/A | N/A | 241580 | 241599 | GTCTACTTCTTATCATTCAC | 27 | 936 |
| 1250146 | N/A | N/A | 243755 | 243774 | TTGCTTCTATATCATACAAA | 10 | 937 |

TABLE 13-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250172 | N/A | N/A | 247052 | 247071 | AGTAACTATTTTCTTAGTTA | 33 | 938 |
| 1250198 | N/A | N/A | 250409 | 250428 | ACTTCAAATTTATATTCCTC | 16 | 939 |
| 1250224 | N/A | N/A | 253927 | 253946 | AAATTATGCCATATTAGTCA | 27 | 940 |
| 1250250 | N/A | N/A | 255087 | 255106 | TCTATTCATTCAAATTGTAT | 70 | 941 |
| 1250276 | N/A | N/A | 256995 | 257014 | CTCTAAAATTCCTTTTGCTT | 55 | 942 |
| 1250301 | N/A | N/A | 259522 260899 | 259541 260918 | AGTAGTGTAAATAGGGAAGC | 33 | 943 |

TABLE 14

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910023 | 4598 | 4617 | 253603 | 253622 | GGTTGTCTTCATACTTGGGT | 19 | 109 |
| 910263 | N/A | N/A | 180777 | 180796 | GCACTACCATGCCTTCACCA | 23 | 227 |
| 1248335 | 108 | 127 | 112521 | 112540 | GTAAAATCTCACATGTGCTC | 59 | 944 |
| 1248361 | 402 | 421 | 168947 | 168966 | TTTTCATCATCCTCATCCTT | 48 | 945 |
| 1248387 | 1039 | 1058 | 183386 | 183405 | GCTTAGACAGAACACAGTCA | 38 | 946 |
| 1248413 | 1712 | 1731 | 188521 | 188540 | CTGAAAAACTCCTATCCCA | 48 | 947 |
| 1248439 | 2384 | 2403 | 199941 | 199960 | TGGCTATACTCATTGCTCTT | 20 | 948 |
| 1248465 | 2762 | 2781 | 215391 | 215410 | AACTAAGGCTCACAATAAAA | 54 | 949 |
| 1248491 | 3711 | 3730 | 238176 | 238195 | GGAGCTCCAATATCAACCGT | 45 | 950 |
| 1248517 | 4034 | 4053 | 243206 | 243225 | GCAGCATTTCCAGAATGAAT | 25 | 951 |
| 1248568 | 6260 | 6279 | 262788 | 262807 | TGATATCTTTCCCTTTGTCT | 57 | 952 |
| 1248594 | 7025 | 7044 | 263553 | 263572 | AAACAACTCTTTAATGCTTG | 51 | 953 |
| 1248620 | 7298 | 7317 | 263826 | 263845 | TGCAGGATAAAGCAGAATCA | 42 | 954 |
| 1248645 | 7431 | 7450 | 263959 | 263978 | CTTAAATCATCATTTTGTT | 88 | 955 |
| 1248670 | 7534 | 7553 | 264062 | 264081 | GTGACAGCTTCAAACTATAA | 64 | 956 |
| 1248695 | 7842 | 7861 | 264370 | 264389 | AATGAACTTTTTACAGTATT | 60 | 957 |
| 1248720 | 8101 | 8120 | 264629 | 264648 | CAATGATAAGGCATTACTAT | 69 | 958 |
| 1248746 | 8382 | 8401 | 264910 | 264929 | CAGTATAAAGAATCTACATT | 69 | 959 |
| 1248772 | 8529 | 8548 | 265057 | 265076 | AAAGATAGAAACAAAGACAA | 82 | 960 |
| 1248798 | 8661 | 8680 | 265189 | 265208 | ACTCTTCTTAATTAACTTCC | 53 | 961 |
| 1248822 | N/A | N/A | 112684 | 112703 | ATGTCATTCTTAACATAGAT | 68 | 962 |
| 1248848 | N/A | N/A | 114869 | 114888 | CTTTATTTATATCCAACTCA | 84 | 963 |
| 1248874 | N/A | N/A | 118831 | 118850 | GGCAACAAAATCATGAACAA | 57 | 964 |

TABLE 14-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248900 | N/A | N/A | 124931 | 124950 | TTATATTTTAAATTTAGTCA | 73 | 965 |
| 1248926 | N/A | N/A | 128080 | 128099 | TGGTTAATTTATAATTAACC | 88 | 966 |
| 1248951 | N/A | N/A | 131500 | 131519 | CTGTTTTCCATAATTGCTGA | 63 | 967 |
| 1248977 | N/A | N/A | 142005 | 142024 | CCAACATTTTCCATTCCTCC | 110 | 968 |
| 1249003 | N/A | N/A | 145369 | 145388 | CTTTTTACTTTATTCTGCCA | 86 | 969 |
| 1249029 | N/A | N/A | 146372 | 146391 | CCCAAGAGATCATTTAGTCA | 65 | 970 |
| 1249055 | N/A | N/A | 150101 | 150120 | ATTACATTATCTTTTACTAA | 88 | 971 |
| 1249081 | N/A | N/A | 153912 | 153931 | AACTTATTAATAATTATTTA | 95 | 972 |
| 1249107 | N/A | N/A | 157753 | 157772 | ATTCTGGATTTTAATAATCA | 101 | 973 |
| 1249133 | N/A | N/A | 162869 | 162888 | GTTTCCTTAACATTATATTA | 75 | 974 |
| 1249159 | N/A | N/A | 167780 | 167799 | AATCATATTTCACCAGACTA | 44 | 975 |
| 1249185 | N/A | N/A | 171260 | 171279 | TTCAAATATTTTCTAGGCCT | 26 | 976 |
| 1249211 | N/A | N/A | 172186 | 172205 | TCAGAATTTCTTAAACTGCC | 36 | 977 |
| 1249237 | N/A | N/A | 172998 | 173017 | CATAATTTCTCATTCAGCCA | 14 | 978 |
| 1249263 | N/A | N/A | 174585 | 174604 | ATACATTTATCATTATTAA | 86 | 979 |
| 1249289 | N/A | N/A | 175992 | 176011 | ATAAACCTTTTATAATATCA | 72 | 980 |
| 1249315 | N/A | N/A | 176968 | 176987 | GACACTTAAAAACTTACTCT | 21 | 981 |
| 1249341 | N/A | N/A | 177954 | 177973 | GTTTGGCTCCATTTAATCCA | 12 | 982 |
| 1249367 | N/A | N/A | 178471 | 178490 | ATCTACCTCTCTTCTACTCT | 59 | 983 |
| 1249393 | N/A | N/A | 179939 | 179958 | ACTTTCATATTTAATAAAAA | 72 | 984 |
| 1249419 | N/A | N/A | 180715 | 180734 | TTATTATTCTATTATTGACC | 55 | 985 |
| 1249445 | N/A | N/A | 181954 | 181973 | GCCATGTAATTTACTATGAT | 20 | 986 |
| 1249471 | N/A | N/A | 183775 | 183794 | ATGAGAACTTTTACTATATC | 37 | 987 |
| 1249497 | N/A | N/A | 184633 | 184652 | TTTCATGCAAATAAATTTTA | 80 | 988 |
| 1249523 | N/A | N/A | 185621 | 185640 | CACTTCATCATCACAAAAAC | 58 | 989 |
| 1249549 | N/A | N/A | 186396 | 186415 | CTGTGATTCATAATTGTCAT | 35 | 990 |
| 1249575 | N/A | N/A | 189605 | 189624 | ATATTGCAAATAACAACACA | 59 | 991 |
| 1249601 | N/A | N/A | 190841 | 190860 | ACTATTTCTTTATCAAGCAA | 30 | 992 |
| 1249627 | N/A | N/A | 194862 | 194881 | AACCATTATTTTATACCTAC | 43 | 993 |
| 1249653 | N/A | N/A | 200422 | 200441 | TACAAAATTTTAAACACTTT | 107 | 994 |
| 1249679 | N/A | N/A | 201735 | 201754 | ATTGCACTTATTCCTAGAAC | 29 | 995 |
| 1249705 | N/A | N/A | 202858 | 202877 | ACTTTGTAAACAATAAATAA | 100 | 996 |
| 1249731 | N/A | N/A | 203355 | 203374 | TCTACCATCTTCCTTTGGCA | 35 | 997 |
| 1249757 | N/A | N/A | 203931 | 203950 | CCTAAGAACCTTAATCAGTC | 51 | 998 |
| 1249783 | N/A | N/A | 206377 | 206396 | CCTATAACTTATCCTAGGGA | 82 | 999 |
| 1249809 | N/A | N/A | 208139 | 208158 | ATTTTCCTCTAATCTATGAA | 49 | 1000 |

TABLE 14-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249835 | N/A | N/A | 209449 | 209468 | GTTCACTTAATATAATATAT | 62 | 1001 |
| 1249861 | N/A | N/A | 210870 | 210889 | GTATTTACCCACATTTATTC | 70 | 1002 |
| 1249887 | N/A | N/A | 213850 | 213869 | ATTTTTTAAACAATTATCTT | 78 | 1003 |
| 1249913 | N/A | N/A | 216831 | 216850 | ATATTATATTCAAATACAAA | 86 | 1004 |
| 1249939 | N/A | N/A | 222281 | 222300 | TTTCATAAATTAAATTCTAC | 96 | 1005 |
| 1249965 | N/A | N/A | 226213 | 226232 | TGGTTATTATACAATAATTA | 76 | 1006 |
| 1249991 | N/A | N/A | 229542 | 229561 | ACTTTTTTTACTATTAGGGA | 58 | 1007 |
| 1250017 | N/A | N/A | 231902 | 231921 | TGTGATTTCAACATTAAGAA | 34 | 1008 |
| 1250043 | N/A | N/A | 234957 | 234976 | AATATTTTCTCTTAATTGCA | 84 | 1009 |
| 1250069 | N/A | N/A | 236196 | 236215 | CAGGTCTTAATAAATTTTGC | 25 | 1010 |
| 1250095 | N/A | N/A | 237827 | 237846 | AGTCATATAATCATCTGCGA | 32 | 1011 |
| 1250121 | N/A | N/A | 241678 | 241697 | ATTATATTAATATTTTGATC | 92 | 1012 |
| 1250147 | N/A | N/A | 243864 | 243883 | GCCTCATATTCAATTATATA | 28 | 1013 |
| 1250173 | N/A | N/A | 247187 | 247206 | ACTGTTCTTTCTAATTGGTA | 48 | 1014 |
| 1250199 | N/A | N/A | 250509 | 250528 | GATCAAAATTCTATTTGACA | 22 | 1015 |
| 1250225 | 4774 | 4793 | 254142 255535 | 254161 255554 | ACCCAGTTTTTTCATTGCAT | 25 | 1016 |
| 1250251 | N/A | N/A | 255125 | 255144 | TACATTTCTCATACAGTAA | 59 | 1017 |
| 1250277 | N/A | N/A | 257136 | 257155 | TTCTTTTCATATATTACTCC | 37 | 1018 |
| 1250302 | N/A | N/A | 259524 260901 | 259543 260920 | TAAGTAGTGTAAATAGGGAA | 55 | 1019 |

TABLE 15

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 909602 | 7311 | 7330 | 263839 | 263858 | GGCTAAACAATACTGCAGGA | 21 | 1020 |
| 910263 | N/A | N/A | 180777 | 180796 | GCACTACCATGCCTTCACCA | 16 | 227 |
| 910391 | N/A | N/A | 259525 260902 | 259544 260921 | GTAAGTAGTGTAAATAGGGA | 58 | 404 |
| 1248336 | 114 | 133 | 112527 | 112546 | TAGAAAGTAAAATCTCACAT | 60 | 1021 |
| 1248362 | 403 | 422 | 168948 | 168967 | ATTTTCATCATCCTCATCCT | 37 | 1022 |
| 1248388 | 1067 | 1086 | 183414 | 183433 | ACAACTGCAATCCTATTAGC | 53 | 1023 |
| 1248414 | 1761 | 1780 | 188570 | 188589 | AGCTCTTTTTCACTTTTGGA | 19 | 1024 |
| 1248440 | 2385 | 2404 | 199942 | 199961 | CTGGCTATACTCATTGCTCT | 22 | 1025 |
| 1248466 | 2771 | 2790 | 215400 | 215419 | GTTCCATTAAACTAAGGCTC | 18 | 1026 |

TABLE 15-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
| --- | --- | --- | --- | --- | --- | --- | --- |
| 1248492† | 3756 | 3775 | 238221 | 238240 | TCAAGGGATTCCTCAGGTTC | 36 | 1027 |
| 1248518 | 4062 | 4081 | 243234 | 243253 | ACTTGAAAACCATATGCAAC | 34 | 1028 |
| 1248543 | 4601 | 4620 | 253606 | 253625 | ACAGGTTGTCTTCATACTTG | 21 | 1029 |
| 1248569 | 6261 | 6280 | 262789 | 262808 | CTGATATCTTTCCCTTTGTC | 56 | 1030 |
| 1248595 | 7026 | 7045 | 263554 | 263573 | AAAACAACTCTTTAATGCTT | 48 | 1031 |
| 1248646 | 7432 | 7451 | 263960 | 263979 | GCTTAAATCATCATTTTTGT | 34 | 1032 |
| 1248671 | 7535 | 7554 | 264063 | 264082 | AGTGACAGCTTCAAACTATA | 45 | 1033 |
| 1248696 | 7888 | 7907 | 264416 | 264435 | CTTTTAATTTCTCATTTTAC | 54 | 1034 |
| 1248721 | 8109 | 8128 | 264637 | 264656 | GCCTCTTTCAATGATAAGGC | 43 | 1035 |
| 1248747 | 8387 | 8406 | 264915 | 264934 | AGCTTCAGTATAAAGAATCT | 64 | 1036 |
| 1248773 | 8538 | 8557 | 265066 | 265085 | TGGCATTTCAAAGATAGAAA | 43 | 1037 |
| 1248799 | 8662 | 8681 | 265190 | 265209 | CACTCTTCTTAATTAACTTC | 62 | 1038 |
| 1248823 | N/A | N/A | 112776 | 112795 | AGGAAGATTTTAAATTGCAC | 61 | 1039 |
| 1248849 | N/A | N/A | 114925 | 114944 | TTTCTTGTATTTACTTGCCT | 59 | 1040 |
| 1248875 | N/A | N/A | 118847 | 118866 | AACTTTCTAACACTTAGGCA | 59 | 1041 |
| 1248901 | N/A | N/A | 124966 | 124985 | ATGAAGGTATTTAAAATCTA | 68 | 1042 |
| 1248927 | N/A | N/A | 128432 | 128451 | GAGAACATTTTTAAATTAAC | 66 | 1043 |
| 1248952 | N/A | N/A | 132130 | 132149 | AGATGTAATTCTATTACATA | 92 | 1044 |
| 1248978 | N/A | N/A | 142265 | 142284 | TCAATTATATTTAATTGACA | 97 | 1045 |
| 1249004 | N/A | N/A | 145404 | 145423 | GATAAATCTCTAACAATTA | 83 | 1046 |
| 1249030 | N/A | N/A | 146412 | 146431 | GCAAATTAAAATAATGGGTT | 71 | 1047 |
| 1249056 | N/A | N/A | 150294 | 150313 | TTTTTAACAATTATAAGTAA | 72 | 1048 |
| 1249082 | N/A | N/A | 155779 | 155798 | CACCATCATTCACTTAGATT | 74 | 1049 |
| 1249108 | N/A | N/A | 157867 | 157886 | CAAGAACTCATTCAACCGTC | 74 | 1050 |
| 1249134 | N/A | N/A | 163446 | 163465 | CCATTTATTCCTTATAGCAA | 65 | 1051 |
| 1249160 | N/A | N/A | 167788 | 167807 | GGTATTCAAATCATATTTCA | 21 | 1052 |
| 1249186 | N/A | N/A | 171261 | 171280 | ATTCAAATATTTTCTAGGCC | 44 | 1053 |
| 1249212 | N/A | N/A | 172280 | 172299 | CAGGAAGCAAATACAAGCCC | 25 | 1054 |
| 1249238 | N/A | N/A | 173006 | 173025 | ATCACAAGCATAATTTCTCA | 36 | 1055 |
| 1249264 | N/A | N/A | 174698 | 174717 | TTTTTGCTAATCTTACAGCA | 49 | 1056 |
| 1249290 | N/A | N/A | 175997 | 176016 | GGCAGATAAACCTTTTATAA | 51 | 1057 |
| 1249316 | N/A | N/A | 176969 | 176988 | TGACACTTAAAAACTTACTC | 21 | 1058 |
| 1249342 | N/A | N/A | 178010 | 178029 | CTAATAGTCCATCTAGATTA | 44 | 1059 |
| 1249368 | N/A | N/A | 178516 | 178535 | GTGGCATTTTCTTTTTGAA | 34 | 1060 |
| 1249394 | N/A | N/A | 179942 | 179961 | ATGACTTTCATATTTAATAA | 67 | 1061 |
| 1249420 | N/A | N/A | 180753 | 180772 | GAAGTTTAAAACTTTAGTGC | 29 | 1062 |

TABLE 15-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249446 | N/A | N/A | 181986 | 182005 | TTTATTACTTTACAGTGCTA | 23 | 1063 |
| 1249472 | N/A | N/A | 183795 | 183814 | ATAAGACAACACATTTTCAA | 52 | 1064 |
| 1249498 | N/A | N/A | 184734 | 184753 | AATATAAGCTCAAATTGCAT | 62 | 1065 |
| 1249524 | N/A | N/A | 185624 | 185643 | ATCCACTTCATCATCACAAA | 39 | 1066 |
| 1249550 | N/A | N/A | 186441 | 186460 | ATTTATATAATAACAGAATC | 75 | 1067 |
| 1249576 | N/A | N/A | 189618 | 189637 | GCTTAATGCATTAATATTGC | 13 | 1068 |
| 1249602 | N/A | N/A | 191017 | 191036 | GTTTGACATTTTCAGTATTA | 14 | 1069 |
| 1249628 | N/A | N/A | 194924 | 194943 | ACTTCATCATTTAAGTATTA | 53 | 1070 |
| 1249654 | N/A | N/A | 200423 | 200442 | CTACAAAATTTTAAACACTT | 84 | 1071 |
| 1249680 | N/A | N/A | 201767 | 201786 | AACGAAAACACTCTCAGTCT | 52 | 1072 |
| 1249706 | N/A | N/A | 202859 | 202878 | AACTTTGTAAACAATAAATA | 91 | 1073 |
| 1249732 | N/A | N/A | 203360 | 203379 | AACTGTCTACCATCTTCCTT | 45 | 1074 |
| 1249758 | N/A | N/A | 204009 | 204028 | TTGCATACACTTAAAGCTCA | 69 | 1075 |
| 1249784 | N/A | N/A | 206383 | 206402 | ACCTAACCTATAACTTATCC | 79 | 1076 |
| 1249810 | N/A | N/A | 208150 | 208169 | ATCTTAACAATATTTTCCTC | 43 | 1077 |
| 1249836 | N/A | N/A | 209454 | 209473 | GCTTTGTTCACTTAATATAA | 27 | 1078 |
| 1249862 | N/A | N/A | 210961 | 210980 | ATTTACAATTTATTTATGCA | 68 | 1079 |
| 1249888 | N/A | N/A | 213855 | 213874 | ACGAAATTTTTTAAACAATT | 82 | 1080 |
| 1249914 | N/A | N/A | 216848 | 216867 | GGCTATATTTTAAACATATA | 54 | 1081 |
| 1249940 | N/A | N/A | 222282 | 222301 | TTTTCATAAATTAAATTCTA | 86 | 1082 |
| 1249966 | N/A | N/A | 226251 | 226270 | GCTACTATAATTATACAATA | 43 | 1083 |
| 1249992 | N/A | N/A | 229546 | 229565 | ATTGACTTTTTTACTATTA | 42 | 1084 |
| 1250018 | N/A | N/A | 231976 | 231995 | ACAAAATAATTAACATTTCT | 89 | 1085 |
| 1250044 | N/A | N/A | 235015 | 235034 | CACTAACTACTAACACTTCC | 69 | 1086 |
| 1250070 | N/A | N/A | 236284 | 236303 | TGAGGATCCATATTCAGGGT | 17 | 1087 |
| 1250096 | N/A | N/A | 238319 | 238338 | AGACATTTAAATAAATAGGA | 84 | 1088 |
| 1250122 | N/A | N/A | 241687 | 241706 | ATCATTTTCATTATATTAAT | 76 | 1089 |
| 1250148 | N/A | N/A | 243917 | 243936 | CTGCATGTAACCTTTATACA | 20 | 1090 |
| 1250174 | N/A | N/A | 247339 | 247358 | TTTCAAAAAATCATACAAAC | 96 | 1091 |
| 1250200 | N/A | N/A | 250553 | 250572 | CTTTTTTCCCAAAATTATAA | 65 | 1092 |
| 1250226 | 4775 | 4794 | 254143 255536 | 254162 255555 | AACCCAGTTTTTTCATTGCA | 23 | 1093 |
| 1250252 | N/A | N/A | 255193 | 255212 | CTACTACTCACTAATTCAAA | 71 | 1094 |
| 1250278 | N/A | N/A | 257137 | 257156 | GTTCTTTTCATATATTACTC | 24 | 1095 |

TABLE 16

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 17 | 227 |
| 1248337 | 132 | 151 | 112545 | 112564 | TCAGAATTTTTACTGGAGTA | 73 | 1096 |
| 1248363 | 413 | 432 | 168958 | 168977 | GCTTTGGGCCATTTTCATCA | 19 | 1097 |
| 1248389 | 1069 | 1088 | 183416 | 183435 | GAACAACTGCAATCCTATTA | 33 | 1098 |
| 1248415 | 1767 | 1786 | 188576 | 188595 | TTTTTCAGCTCTTTTTCACT | 49 | 1099 |
| 1248441 | 2386 | 2405 | 199943 | 199962 | ACTGGCTATACTCATTGCTC | 18 | 1100 |
| 1248467 | 2773 | 2792 | 215402 | 215421 | AAGTTCCATTAAACTAAGGC | 28 | 1101 |
| 1248493† | 3814 | 3833 | 240232 | 240251 | GCTTATCTGACAACACTTGA | 10 | 1102 |
| 1248519 | 4064 | 4083 | 243236 | 243255 | ACACTTGAAAACCATATGCA | 23 | 1103 |
| 1248544 | 4790 | 4809 | 254158 | 254177 | TTTGTGGTTTCTTTGAACCC | 36 | 1104 |
| 1248570 | 6275 | 6294 | 262803 | 262822 | ACTTTTTACTTTCCCTGATA | 38 | 1105 |
| 1248596 | 7036 | 7055 | 263564 | 263583 | ATGTAAAAATAAAACAACTC | 78 | 1106 |
| 1248621 | 7314 | 7333 | 263842 | 263861 | GATGGCTAAACAATACTGCA | 35 | 1107 |
| 1248647 | 7434 | 7453 | 263962 | 263981 | GTGCTTAAATCATCATTTTT | 38 | 1108 |
| 1248672 | 7554 | 7573 | 264082 | 264101 | GGCAAGATAAACATGCAGCA | 24 | 1109 |
| 1248697 | 7890 | 7909 | 264418 | 264437 | TACTTTTAATTTCTCATTTT | 63 | 1110 |
| 1248722 | 8118 | 8137 | 264646 | 264665 | TTTCTTTAAGCCTCTTTCAA | 64 | 1111 |
| 1248748 | 8402 | 8421 | 264930 | 264949 | ACACTACAAGTCAATAGCTT | 64 | 1112 |
| 1248774 | 8540 | 8559 | 265068 | 265087 | AATGGCATTTCAAAGATAGA | 55 | 1113 |
| 1248800 | 8663 | 8682 | 265191 | 265210 | ACACTCTTCTTAATTAACTT | 75 | 1114 |
| 1248824 | N/A | N/A | 112777 | 112796 | TAGGAAGATTTTAAATTGCA | 80 | 1115 |
| 1248850 | N/A | N/A | 115244 | 115263 | TTGTTCCCCATTAATGTTTA | 76 | 1116 |
| 1248876 | N/A | N/A | 118851 | 118870 | TTTTAACTTTCTAACACTTA | 108 | 1117 |
| 1248902 | N/A | N/A | 125043 | 125062 | ATTACTTTCACATCTAAGCT | 96 | 1118 |
| 1248928 | N/A | N/A | 128487 128530 128573 | 128506 128549 128592 | TAGAGCCATATTTTAATAAT | 63 | 1119 |
| 1248953 | N/A | N/A | 133376 | 133395 | CTATTCTTTTCAAAATATTA | 89 | 1120 |
| 1248979 | N/A | N/A | 142299 | 142318 | GTTAATAATCCAATATTTTA | 83 | 1121 |
| 1249005 | N/A | N/A | 145407 | 145426 | ATTGATAAATCTCTAACAA | 86 | 1122 |
| 1249031 | N/A | N/A | 146427 | 146446 | GGCACTATAACCAATGCAAA | 48 | 1123 |
| 1249057 | N/A | N/A | 150300 | 150319 | ATTTACTTTTAACAATTAT | 58 | 1124 |
| 1249083 | N/A | N/A | 155814 | 155833 | ACCTCCTCTACCATTAGCAC | 66 | 1125 |
| 1249109 | N/A | N/A | 158023 | 158042 | ACATCTAACTTTCCTAGGAA | 57 | 1126 |
| 1249135 | N/A | N/A | 163447 | 163466 | ACCATTTATTCCTTATAGCA | 62 | 1127 |
| 1249161 | N/A | N/A | 169321 | 169340 | TTGTCCTTCCTTAATTCCCG | 17 | 1128 |
| 1249187 | N/A | N/A | 171276 | 171295 | TCCATACCTTATCTAATTCA | 22 | 1129 |

TABLE 16-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249213 | N/A | N/A | 172339 | 172358 | ACCTGCATCTCCTCAGGCCT | 46 | 1130 |
| 1249239 | N/A | N/A | 173081 | 173100 | TTTATTTAAATATCAAATAA | 74 | 1131 |
| 1249265 | N/A | N/A | 174709 | 174728 | TGAGAGTTTCCTTTTTGCTA | 31 | 1132 |
| 1249291 | N/A | N/A | 176071 | 176090 | GTACATTTTTCAAAAGAACA | 20 | 1133 |
| 1249317 | N/A | N/A | 176973 | 176992 | TTTATGACACTTAAAAACTT | 69 | 1134 |
| 1249343 | N/A | N/A | 178011 | 178030 | TCTAATAGTCCATCTAGATT | 55 | 1135 |
| 1249369 | N/A | N/A | 178752 | 178771 | ATCTATCATATATTCAGCCT | 32 | 1136 |
| 1249395 | N/A | N/A | 179943 | 179962 | AATGACTTTCATATTTAATA | 52 | 1137 |
| 1249421 | N/A | N/A | 180757 | 180776 | CCATGAAGTTTAAAACTTTA | 57 | 1138 |
| 1249447 | N/A | N/A | 182021 | 182040 | TTGTCATCAATCATAATCTC | 25 | 1139 |
| 1249473 | N/A | N/A | 183813 | 183832 | ATTACTTTCAACATGAGTAT | 32 | 1140 |
| 1249499 | N/A | N/A | 184743 | 184762 | TTCATTGCAAATATAAGCTC | 36 | 1141 |
| 1249525 | N/A | N/A | 185632 | 185651 | ATTTATTAATCCACTTCATC | 61 | 1142 |
| 1249551 | N/A | N/A | 186487 | 186506 | ATTTCTCTCACCTTACCCAG | 40 | 1143 |
| 1249577 | N/A | N/A | 189660 | 189679 | GATATTAACTAAATTAGAAC | 64 | 1144 |
| 1249603 | N/A | N/A | 191114 | 191133 | ACAATAATTCCTAATATTTT | 111 | 1145 |
| 1249629 | N/A | N/A | 195681 | 195700 | CCTGATGCAAATCTTACCAT | 44 | 1146 |
| 1249655 | N/A | N/A | 200429 | 200448 | GTAGGACTACAAAATTTTAA | 29 | 1147 |
| 1249681 | N/A | N/A | 201780 | 201799 | CTGCAGATAATAAAACGAAA | 78 | 1148 |
| 1249707 | N/A | N/A | 202870 | 202889 | CCTTAATACATAACTTTGTA | 48 | 1149 |
| 1249733 | N/A | N/A | 203483 | 203502 | CAAGAAGAATTTCAACCAAA | 80 | 1150 |
| 1249759 | N/A | N/A | 204088 | 204107 | TTCCAAGATTCTATTGGCAA | 20 | 1151 |
| 1249785 | N/A | N/A | 206386 | 206405 | ATGACCTAACCTATAACTTA | 67 | 1152 |
| 1249811 | N/A | N/A | 208227 | 208246 | CACTTTCTGCAAAATAGGTA | 15 | 1153 |
| 1249837 | N/A | N/A | 209581 | 209600 | TTGTTGCTCCCATTTACCCT | 39 | 1154 |
| 1249863 | N/A | N/A | 212405 | 212424 | GTTTTTTTTTCCTTTAGTTC | 14 | 1155 |
| 1249889 | N/A | N/A | 214622 | 214641 | ACTTTGTTTCCCTTTATCTA | 52 | 1156 |
| 1249915 | N/A | N/A | 216892 | 216911 | AGATTGTTTTAATCTAGCTA | 63 | 1157 |
| 1249941 | N/A | N/A | 222289 | 222308 | GTCAGCCTTTTCATAAATTA | 41 | 1158 |
| 1249967 | N/A | N/A | 226278 | 226297 | GTCCCAATTTTTATTAAGAC | 24 | 1159 |
| 1249993 | N/A | N/A | 229592 | 229611 | CTTAGTTTATATGACAGCCT | 27 | 1160 |
| 1250019 | N/A | N/A | 231980 | 231999 | AGTGACAAAATAATTAACAT | 79 | 1161 |
| 1250045 | N/A | N/A | 235019 | 235038 | CAACCACTAACTACTAACAC | 62 | 1162 |
| 1250071 | N/A | N/A | 236527 | 236546 | TTCTCATTTAATATATCTA | 57 | 1163 |
| 1250097 | N/A | N/A | 238394 | 238413 | GTATAGATGATTACTAGATA | 67 | 1164 |
| 1250123 | N/A | N/A | 241689 | 241708 | ATATCATTTCATTATATTA | 82 | 1165 |

TABLE 16-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250149 | N/A | N/A | 244053 | 244072 | ATGCATAATCCCATTATACA | 19 | 1166 |
| 1250175 | N/A | N/A | 247346 | 247365 | ACATCACTTTCAAAAAATCA | 66 | 1167 |
| 1250201 | N/A | N/A | 250554 | 250573 | TCTTTTTTCCCAAAATTATA | 82 | 1168 |
| 1250227 | 4776 | 4795 | 254144 255537 | 254163 255556 | GAACCCAGTTTTTTCATTGC | 18 | 1169 |
| 1250253 | N/A | N/A | 255196 | 255215 | TGTCTACTACTCACTAATTC | 50 | 1170 |
| 1250279 | N/A | N/A | 257139 | 257158 | ATGTTCTTTTCATATATTAC | 38 | 1171 |
| 1250303 | N/A | N/A | 259564 260941 | 259583 260960 | TTGGAGAGCTGAGGTAACTT | 38 | 1172 |

TABLE 17

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 23 | 227 |
| 1248338 | 133 | 152 | 112546 | 112565 | TTCAGAATTTTTACTGGAGT | 59 | 1173 |
| 1248364 | 440 | 459 | 168985 | 169004 | ATTTTCCTGCTTCCAAGTCA | 48 | 1174 |
| 1248390 | 1102 | 1121 | 183449 | 183468 | CCATTGCAAACATTTATTTC | 37 | 1175 |
| 1248416 | 1774 | 1793 | 188583 | 188602 | TCTTCTGTTTTTCAGCTCTT | 40 | 1176 |
| 1248442 | 2388 | 2407 | 199945 | 199964 | ATACTGGCTATACTCATTGC | 55 | 1177 |
| 1248468 | 2777 | 2796 | 215406 | 215425 | AACCAAGTTCCATTAAACTA | 53 | 1178 |
| 1248494† | 3820 | 3839 | 240238 | 240257 | TTCTATGCTTATCTGACAAC | 49 | 1179 |
| 1248520 | 4212 | 4231 | 246309 | 246328 | GACAAAGCTCTCAGTGGCCT | 63 | 1180 |
| 1248545 | 4846 | 4865 | 259762 | 259781 | GGTTACAAAATCAAAGACCA | 33 | 1181 |
| 1248571 | 6276 | 6295 | 262804 | 262823 | TACTTTTTACTTTCCCTGAT | 58 | 1182 |
| 1248597 | 7039 | 7058 | 263567 | 263586 | GTTATGTAAAAATAAAACAA | 103 | 1183 |
| 1248622 | 7315 | 7334 | 263843 | 263862 | AGATGGCTAAACAATACTGC | 62 | 1184 |
| 1248648 | 7435 | 7454 | 263963 | 263982 | TGTGCTTAAATCATCATTTT | 55 | 1185 |
| 1248673 | 7596 | 7615 | 264124 | 264143 | TTAGACTTCTGAACAGTGGA | 47 | 1186 |
| 1248698 | 7891 | 7910 | 264419 | 264438 | ATACTTTTAATTTCTCATTT | 82 | 1187 |
| 1248723 | 8196 | 8215 | 264724 | 264743 | GACTGATGATTACTGAATAA | 57 | 1188 |
| 1248749 | 8408 | 8427 | 264936 | 264955 | ACCAACACACTACAAGTCAA | 52 | 1189 |
| 1248775 | 8543 | 8562 | 265071 | 265090 | TTAAATGGCATTTCAAAGAT | 70 | 1190 |
| 1248801 | 8664 | 8683 | 265192 | 265211 | TACACTCTTCTTAATTAACT | 88 | 1191 |
| 1248825 | N/A | N/A | 112974 | 112993 | ATCTGCTTCATTATATCTCT | 64 | 1192 |
| 1248851 | N/A | N/A | 115394 | 115413 | TTTTGATATTCAATTTACCT | 72 | 1193 |

TABLE 17-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
| --- | --- | --- | --- | --- | --- | --- | --- |
| 1248877 | N/A | N/A | 118854 | 118873 | ACATTTAACTTTCTAACAC | 82 | 1194 |
| 1248903 | N/A | N/A | 125052 | 125071 | AGCATATTAATTACTTTCAC | 64 | 1195 |
| 1248929 | N/A | N/A | 128488 128531 128574 | 128507 128550 128593 | ATAGAGCCATATTTTAATAA | 85 | 1196 |
| 1248954 | N/A | N/A | 134288 | 134307 | CTTTAGAGATAATCTAGTCC | 77 | 1197 |
| 1248980 | N/A | N/A | 142450 | 142469 | GCTTAAGAACACATTAGTGA | 78 | 1198 |
| 1249006 | N/A | N/A | 145828 | 145847 | ATGTTGTATTCTAATTATCA | 83 | 1199 |
| 1249032 | N/A | N/A | 146480 | 146499 | AATTAAATCCCTACTTTATA | 92 | 1200 |
| 1249058 | N/A | N/A | 150301 | 150320 | AATTTACTTTTTAACAATTA | 100 | 1201 |
| 1249084 | N/A | N/A | 155818 | 155837 | TCTCACCTCCTCTACCATTA | 64 | 1202 |
| 1249110 | N/A | N/A | 158105 | 158124 | TGCTTTTCTTTAACAGAAAT | 86 | 1203 |
| 1249136 | N/A | N/A | 163471 | 163490 | AAGCACTATTTTAAGAGCTA | 85 | 1204 |
| 1249162 | N/A | N/A | 169323 | 169342 | TTTTGTCCTTCCTTAATTCC | 51 | 1205 |
| 1249188 | N/A | N/A | 171502 | 171521 | GAAACATAAACATCAAATAA | 86 | 1206 |
| 1249214 | N/A | N/A | 172351 | 172370 | CTTCACATTTCAACCTGCAT | 40 | 1207 |
| 1249240 | N/A | N/A | 173085 | 173104 | ATGTTTTATTTAAATATCAA | 64 | 1208 |
| 1249266 | N/A | N/A | 175089 | 175108 | GGACACTATTTAATGAATCA | 20 | 1209 |
| 1249292 | N/A | N/A | 176648 | 176667 | TTAATTTATTTCATCAGTCA | 77 | 1210 |
| 1249318 | N/A | N/A | 177473 | 177492 | ATTTTGCAATTCATTTGTTA | 40 | 1211 |
| 1249344 | N/A | N/A | 178020 | 178039 | AGCATCAAATCTAATAGTCC | 22 | 1212 |
| 1249370 | N/A | N/A | 178775 | 178794 | GCTTATCTTTCCTTTTCTTA | 28 | 1213 |
| 1249396 | N/A | N/A | 179945 | 179964 | GTAATGACTTTCATATTTAA | 37 | 1214 |
| 1249422 | N/A | N/A | 180767 | 180786 | GCCTTCACCACCATGAAGTT | 36 | 1215 |
| 1249448 | N/A | N/A | 182025 | 182044 | GGCATTGTCATCAATCATAA | 19 | 1216 |
| 1249474 | N/A | N/A | 183842 | 183861 | AAACATTTTTAATATGGCA | 43 | 1217 |
| 1249500 | N/A | N/A | 184763 | 184782 | ATAACATTCTTATATCAGCA | 31 | 1218 |
| 1249526 | N/A | N/A | 185637 | 185656 | TATACATTTATTAATCCACT | 46 | 1219 |
| 1249552 | N/A | N/A | 186521 | 186540 | ATGTCTGTTTTATACAGGCA | 58 | 1220 |
| 1249578 | N/A | N/A | 189685 | 189704 | CTTCTCTTCACATATAAAAA | 54 | 1221 |
| 1249604 | N/A | N/A | 191169 | 191188 | TAGTTTTTCAATACAAACAC | 48 | 1222 |
| 1249630 | N/A | N/A | 199983 | 200002 | GCAGGACTTTTAACATACCT | 65 | 1223 |
| 1249656 | N/A | N/A | 200498 | 200517 | ATTCAGATAAAATCTGCAAC | 77 | 1224 |
| 1249682 | N/A | N/A | 201811 | 201830 | TTATTTCTCACAAATACACA | 72 | 1225 |
| 1249708 | N/A | N/A | 202877 | 202896 | CCATTTCCCTTAATACATAA | 30 | 1226 |
| 1249734 | N/A | N/A | 203538 | 203557 | TGACATAAAATTTTATATTA | 93 | 1227 |
| 1249760 | N/A | N/A | 204253 | 204272 | TTGGTTTAAATTAAAAGGAA | 54 | 1228 |

TABLE 17-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249786 | N/A | N/A | 206387 | 206406 | TATGACCTAACCTATAACTT | 64 | 1229 |
| 1249812 | N/A | N/A | 208303 | 208322 | CTTTATTTTTTTCTAGTTA | 65 | 1230 |
| 1249838 | N/A | N/A | 209815 | 209834 | AAGGTGATATATACAAGAAC | 45 | 1231 |
| 1249864 | N/A | N/A | 212579 | 212598 | GTTAAATTTATTACTATATT | 99 | 1232 |
| 1249890 | N/A | N/A | 214990 | 215009 | GTCTCTGATCTTTCTAGCCC | 29 | 1233 |
| 1249916 | N/A | N/A | 216948 | 216967 | ATCAACACTTAAATTACATA | 53 | 1234 |
| 1249942 | N/A | N/A | 222521 | 222540 | ATTCTCTTTTCAACTTCAAT | 57 | 1235 |
| 1249968 | N/A | N/A | 226381 | 226400 | CCAATATATTTAAATATGAT | 88 | 1236 |
| 1249994 | N/A | N/A | 229604 | 229623 | GTATAATTCATTCTTAGTTT | 40 | 1237 |
| 1250020 | N/A | N/A | 231981 | 232000 | AAGTGACAAAATAATTAACA | 76 | 1238 |
| 1250046 | N/A | N/A | 235022 | 235041 | ATCCAACCACTAACTACTAA | 62 | 1239 |
| 1250072 | N/A | N/A | 236528 | 236547 | CTTCTCATTTTAATATATCT | 43 | 1240 |
| 1250098 | N/A | N/A | 238454 | 238473 | GCATTTTTTTCAAACAGCA | 28 | 1241 |
| 1250124 | N/A | N/A | 241720 | 241739 | ACATTGTATCACCAATTAA | 70 | 1242 |
| 1250150 | N/A | N/A | 244154 | 244173 | CTTTTATCCTAACATAGATA | 91 | 1243 |
| 1250176 | N/A | N/A | 247429 | 247448 | GCAAATTTACCTCAAAGGAT | 47 | 1244 |
| 1250202 | N/A | N/A | 250658 | 250677 | AAACAATTTCCCTCTAACTA | 80 | 1245 |
| 1250228 | 4778 | 4797 | 254146 255539 | 254165 255558 | TTGAACCCAGTTTTTTCATT | 49 | 1246 |
| 1250254 | N/A | N/A | 255310 | 255329 | TCTTTTCACATTACTAGGCT | 34 | 1247 |
| 1250280 | N/A | N/A | 257269 | 257288 | AGATAATTCCAAACTTCTCA | 43 | 1248 |
| 1250304 | N/A | N/A | 259587 260964 | 259606 260983 | AAAATTCCTTGCAAAACCAG | 62 | 1249 |

TABLE 18

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 20 | 227 |
| 1248339 | 139 | 158 | 112552 | 112571 | CAATTCTTCAGAATTTTTAC | 75 | 1250 |
| 1248365 | 446 | 465 | 168991 | 169010 | GAAGAGATTTTCCTGCTTCC | 25 | 1251 |
| 1248391 | 1103 | 1122 | 183450 | 183469 | GCCATTGCAAACATTTATTT | 26 | 1252 |
| 1248417 | 1818 | 1837 | 188627 | 188646 | TTTTTCTCTTCTTCTCCAGA | 43 | 1253 |
| 1248443 | 2398 | 2417 | 199955 | 199974 | GTTGGTCAAAATACTGGCTA | 23 | 1254 |
| 1248469 | 2798 | 2817 | 215427 | 215446 | ACAATCCTTCCACATTTGCC | 31 | 1255 |

TABLE 18-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248495† | 3821 | 3840 | 240239 | 240258 | CTTCTATGCTTATCTGACAA | 15 | 1256 |
| 1248521 | 4213 | 4232 | 246310 | 246329 | GGACAAAGCTCTCAGTGGCC | 28 | 1257 |
| 1248546 | 4847 | 4866 | 259763 | 259782 | TGGTTACAAAATCAAAGACC | 33 | 1258 |
| 1248572 | 6280 | 6299 | 262808 | 262827 | TTTTTACTTTTTACTTTCCC | 44 | 1259 |
| 1248598 | 7040 | 7059 | 263568 | 263587 | GGTTATGTAAAAATAAAACA | 86 | 1260 |
| 1248623 | 7317 | 7336 | 263845 | 263864 | GAAGATGGCTAAACAATACT | 57 | 1261 |
| 1248649 | 7437 | 7456 | 263965 | 263984 | AGTGTGCTTAAATCATCATT | 39 | 1262 |
| 1248674 | 7611 | 7630 | 264139 | 264158 | ATATGGCTTCCCATATTAGA | 32 | 1263 |
| 1248699 | 7894 | 7913 | 264422 | 264441 | AAGATACTTTTAATTTCTCA | 53 | 1264 |
| 1248724 | 8217 | 8236 | 264745 | 264764 | GTGTAAACAAACATTGGAAA | 59 | 1265 |
| 1248750 | 8409 | 8428 | 264937 | 264956 | CACCAACACACTACAAGTCA | 40 | 1266 |
| 1248776 | 8552 | 8571 | 265080 | 265099 | AATCTACCTTTAAATGGCAT | 56 | 1267 |
| 1248802 | 8665 | 8684 | 265193 | 265212 | ATACACTCTTCTTAATTAAC | 70 | 1268 |
| 1248826 | N/A | N/A | 113346 | 113365 | GCACCTTCTATAATATCAAC | 78 | 1269 |
| 1248852 | N/A | N/A | 115559 | 115578 | TCTCATGTCCAATTTAGTCC | 50 | 1270 |
| 1248878 | N/A | N/A | 118858 | 118877 | TTTCACATTTTAACTTTCTA | 67 | 1271 |
| 1248904 | N/A | N/A | 125245 | 125264 | AAGATGCTTATTAATATCTT | 84 | 1272 |
| 1248930 | N/A | N/A | 128489 128532 128575 | 128508 128551 128594 | CATAGAGCCATATTTTAATA | 80 | 1273 |
| 1248955 | N/A | N/A | 134475 | 134494 | ACCTAGTATATAACTTCCCT | 85 | 1274 |
| 1248981 | N/A | N/A | 142643 | 142662 | CTAATAATCCATAAATGTAA | 62 | 1275 |
| 1249007 | N/A | N/A | 145921 | 145940 | TGAAGATAATTAAATGCTAA | 83 | 1276 |
| 1249033 | N/A | N/A | 146488 | 146507 | AGATTTAGAATTAAATCCCT | 85 | 1277 |
| 1249059 | N/A | N/A | 150308 | 150327 | GTTTCTCAATTTACTTTTTA | 51 | 1278 |
| 1249085 | N/A | N/A | 155820 | 155839 | TTTCTCACCTCCTCTACCAT | 82 | 1279 |
| 1249111 | N/A | N/A | 158120 | 158139 | TCCTAAGACACATTTTGCTT | 67 | 1280 |
| 1249137 | N/A | N/A | 163508 | 163527 | TTTTAATAAAAATCTACACA | 83 | 1281 |
| 1249163 | N/A | N/A | 169407 | 169426 | TTTTGCTTCTCAACATTATT | 21 | 1282 |
| 1249189 | N/A | N/A | 171503 | 171522 | TGAAACATAAACATCAAATA | 73 | 1283 |
| 1249215 | N/A | N/A | 172357 | 172376 | GGCTGGCTTCACATTTCAAC | 33 | 1284 |
| 1249241 | N/A | N/A | 173089 | 173108 | AATCATGTTTTATTTAAATA | 116 | 1285 |
| 1249267 | N/A | N/A | 175113 | 175132 | CCATGATATTTTATATCTCA | 22 | 1286 |
| 1249293 | N/A | N/A | 176665 | 176684 | AAGTTTCTAAATCATTGTTA | 55 | 1287 |
| 1249319 | N/A | N/A | 177486 | 177505 | ACTAATGAAATTAATTTTGC | 54 | 1288 |
| 1249345 | N/A | N/A | 178124 | 178143 | ATCTAATTAACCATCAAATA | 63 | 1289 |
| 1249371 | N/A | N/A | 178812 | 178831 | CCTTTTCCATATCATGGCCA | 16 | 1290 |

TABLE 18-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249397 | N/A | N/A | 179978 | 179997 | ACTATTTAAGAAAATATTCA | 74 | 1291 |
| 1249423 | N/A | N/A | 180772 | 180791 | ACCATGCCTTCACCACCATG | 28 | 1292 |
| 1249449 | N/A | N/A | 182095 | 182114 | CTTGGTCTTTCATCAAGACC | 54 | 1293 |
| 1249475 | N/A | N/A | 183843 | 183862 | TAAACATTTTTAATATGGC | 43 | 1294 |
| 1249501 | N/A | N/A | 184814 | 184833 | TGGTTAGCAAATCTATGTTA | 22 | 1295 |
| 1249527 | N/A | N/A | 185638 | 185657 | CTATACATTTATTAATCCAC | 19 | 1296 |
| 1249553 | N/A | N/A | 186540 | 186559 | CCTGTTTTAATATATGCCAA | 33 | 1297 |
| 1249579 | N/A | N/A | 189791 | 189810 | AGTAATGAAAATAATACTAT | 73 | 1298 |
| 1249605 | N/A | N/A | 191172 | 191191 | GTATAGTTTTCAATACAAA | 25 | 1299 |
| 1249631 | N/A | N/A | 200015 | 200034 | TCATCATTACCAAAGCACCA | 30 | 1300 |
| 1249657 | N/A | N/A | 200521 | 200540 | GACTGCTACACATTATGTTA | 25 | 1301 |
| 1249683 | N/A | N/A | 201812 | 201831 | ATTATTTCTCACAAATACAC | 49 | 1302 |
| 1249709 | N/A | N/A | 202878 | 202897 | TCCATTTCCCTTAATACATA | 28 | 1303 |
| 1249735 | N/A | N/A | 203543 | 203562 | AAACATGACATAAAATTTTA | 76 | 1304 |
| 1249761 | N/A | N/A | 204276 | 204295 | TGCTTACTTTCTATTAAGCA | 76 | 1305 |
| 1249787 | N/A | N/A | 206390 | 206409 | TTTTATGACCTAACCTATAA | 79 | 1306 |
| 1249813 | N/A | N/A | 208338 | 208357 | GTAAGTTTTAAAATTTGGAA | 75 | 1307 |
| 1249839 | N/A | N/A | 209913 | 209932 | TGCATATCATCTAATTTTTA | 34 | 1308 |
| 1249865 | N/A | N/A | 212582 | 212601 | TTTGTTAAATTTATTACTAT | 76 | 1309 |
| 1249891 | N/A | N/A | 215059 | 215078 | GTCAATAAAATTAATATTAT | 75 | 1310 |
| 1249917 | N/A | N/A | 216950 | 216969 | ATATCAACACTTAAATTACA | 110 | 1311 |
| 1249943 | N/A | N/A | 222556 | 222575 | CTGATGTCAACCATAAGTAC | 32 | 1312 |
| 1249969 | N/A | N/A | 226405 | 226424 | TTATTCCTAAAATCAACAAT | 69 | 1313 |
| 1249995 | N/A | N/A | 229683 | 229702 | GTCAAGTTAAACATTCCTCA | 21 | 1314 |
| 1250021 | N/A | N/A | 232043 | 232062 | CTACACTTTTATATTAGTGC | 8 | 1315 |
| 1250047 | N/A | N/A | 235023 | 235042 | TATCCAACCACTAACTACTA | 57 | 1316 |
| 1250073 | N/A | N/A | 236627 | 236646 | CATGTTTTTCTAATTTCCTA | 40 | 1317 |
| 1250099 | N/A | N/A | 238495 | 238514 | ATATCTAATTACATAAATTA | 74 | 1318 |
| 1250125 | N/A | N/A | 241760 | 241779 | TAGTTATTAATTAAATTGAA | 101 | 1319 |
| 1250151 | N/A | N/A | 244191 | 244210 | AAGAGTTTCCTTATATTCAA | 34 | 1320 |
| 1250177 | N/A | N/A | 247430 | 247449 | AGCAAATTTACCTCAAAGGA | 35 | 1321 |
| 1250203 | N/A | N/A | 250861 | 250880 | GCCTTGCTAAATACTAGAAA | 38 | 1322 |
| 1250229 | 4779 | 4798 | 254147 255540 | 254166 255559 | TTTGAACCCAGTTTTTTCAT | 42 | 1323 |
| 1250255 | N/A | N/A | 255330 | 255349 | GTTAAACTCTCTAAAATCTT | 76 | 1324 |
| 1250281 | N/A | N/A | 257335 | 257354 | TCTCTAACTTCATCTTGGCC | 52 | 1325 |

TABLE 18-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250305 | N/A | N/A | 259588 260965 | 259607 260984 | AAAAATTCCTTGCAAAACCA | 55 | 1326 |

TABLE 19

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 23 | 227 |
| 1248340 | 140 | 159 | 112553 | 112572 | GCAATTCTTCAGAATTTTTA | 51 | 1327 |
| 1248366 | 555 | 574 | 170026 | 170045 | GCTTTCCCTTTATTCAATAC | 6 | 1328 |
| 1248392 | 1136 | 1155 | 183483 | 183502 | TGATATTTATTTCAAAGGAA | 27 | 1329 |
| 1248418 | 1820 | 1839 | 188629 | 188648 | CATTTTTCTCTTCTTCTCCA | 47 | 1330 |
| 1248444 | 2399 | 2418 | 199956 | 199975 | TGTTGGTCAAAATACTGGCT | 21 | 1331 |
| 1248470 | 2799 | 2818 | 215428 | 215447 | GACAATCCTTCCACATTTGC | 34 | 1332 |
| 1248496† | 3828 | 3847 | 240246 | 240265 | TTGCCTTCTTCTATGCTTAT | 10 | 1333 |
| 1248522 | 4319 | 4338 | 247753 | 247772 | TGATACTGAATATTAGCCAA | 19 | 1334 |
| 1248547 | 4942 | 4961 | 259858 | 259877 | GTTTGTCATTTCTTGACTCT | 30 | 1335 |
| 1248573 | 6284 | 6303 | 262812 | 262831 | TTTCTTTTACTTTTTACTT | 60 | 1336 |
| 1248599 | 7055 | 7074 | 263583 | 263602 | CATGTACATTTAATGGGTTA | 62 | 1337 |
| 1248624 | 7337 | 7356 | 263865 | 263884 | TGTCAACCTTACCAAGAGCA | 25 | 1338 |
| 1248650 | 7439 | 7458 | 263967 | 263986 | GTAGTGTGCTTAAATCATCA | 27 | 1339 |
| 1248675 | 7613 | 7632 | 264141 | 264160 | ATATATGGCTTCCCATATTA | 46 | 1340 |
| 1248700 | 7895 | 7914 | 264423 | 264442 | GAAGATACTTTTAATTTCTC | 43 | 1341 |
| 1248725 | 8219 | 8238 | 264747 | 264766 | CTGTGTAAACAAACATTGGA | 30 | 1342 |
| 1248751 | 8410 | 8429 | 264938 | 264957 | TCACCAACACACTACAAGTC | 52 | 1343 |
| 1248777 | 8553 | 8572 | 265081 | 265100 | AAATCTACCTTTAAATGGCA | 66 | 1344 |
| 1248803 | 8666 | 8685 | 265194 | 265213 | AATACACTCTTCTTAATTAA | 71 | 1345 |
| 1248827 | N/A | N/A | 113347 | 113366 | AGCACCTTCTATAATATCAA | 64 | 1346 |
| 1248853 | N/A | N/A | 115616 | 115635 | TATCTCTCCTACCTTTCCCT | 73 | 1347 |
| 1248879 | N/A | N/A | 119056 | 119075 | GCATAATTTACTAACAGTTT | 65 | 1348 |
| 1248905 | N/A | N/A | 125264 | 125283 | ATACTTTTTCCAAAGTATTA | 112 | 1349 |
| 1248931 | N/A | N/A | 128490 128533 128576 | 128509 128552 128595 | CCATAGAGCCATATTTTAAT | 65 | 1350 |
| 1248956 | N/A | N/A | 134574 | 134593 | AGGTGATTCACCTTATTTTA | 73 | 1351 |
| 1248982 | N/A | N/A | 142705 | 142724 | TTCTTTTTCCATTTGAATAA | 87 | 1352 |

TABLE 19-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249008 | N/A | N/A | 145922 | 145941 | CTGAAGATAATTAAATGCTA | 59 | 1353 |
| 1249034 | N/A | N/A | 146537 | 146556 | GAAAATATTTTTCAACATTA | 76 | 1354 |
| 1249060 | N/A | N/A | 150312 | 150331 | TATTGTTTCTCAATTTACTT | 71 | 1355 |
| 1249086 | N/A | N/A | 155823 | 155842 | TCATTTCTCACCTCCTCTAC | 76 | 1356 |
| 1249112 | N/A | N/A | 158146 | 158165 | AGATATTCCATTAAATGATT | 70 | 1357 |
| 1249138 | N/A | N/A | 163512 | 163531 | CTTTTTTTAATAAAAATCTA | 80 | 1358 |
| 1249164 | N/A | N/A | 169771 | 169790 | GCCATAGGAATTCTTAGCAA | 5 | 1359 |
| 1249190 | N/A | N/A | 171560 | 171579 | AGGTAAGAAAACATTATTGC | 25 | 1360 |
| 1249216 | N/A | N/A | 172381 | 172400 | TGGCATACCTTAATAGATTT | 17 | 1361 |
| 1249242 | N/A | N/A | 173200 | 173219 | GTGCATATATTAACTTAAAA | 22 | 1362 |
| 1249268 | N/A | N/A | 175218 | 175237 | CAGTAGATAACTAAATGATA | 26 | 1363 |
| 1249294 | N/A | N/A | 176724 | 176743 | CAAGTTTTTACGCTTGTGGT | 12 | 1364 |
| 1249320 | N/A | N/A | 177528 | 177547 | ATTATTCACCATTATAGCCT | 23 | 1365 |
| 1249346 | N/A | N/A | 178128 | 178147 | TCATATCTAATTAACCATCA | 24 | 1366 |
| 1249372 | N/A | N/A | 178821 | 178840 | CCTTATCTCCCTTTTCCATA | 59 | 1367 |
| 1249398 | N/A | N/A | 179983 | 180002 | AAACAACTATTTAAGAAAAT | 97 | 1368 |
| 1249424 | N/A | N/A | 180774 | 180793 | CTACCATGCCTTCACCACCA | 23 | 1369 |
| 1249450 | N/A | N/A | 182096 | 182115 | CCTTGGTCTTTCATCAAGAC | 40 | 1370 |
| 1249476 | N/A | N/A | 183849 | 183868 | ACCAAATAAACATTTTTTAA | 90 | 1371 |
| 1249502 | N/A | N/A | 184829 | 184848 | TTTTGATTATACAAATGGTT | 28 | 1372 |
| 1249528 | N/A | N/A | 185639 | 185658 | GCTATACATTTATTAATCCA | 17 | 1373 |
| 1249554 | N/A | N/A | 186541 | 186560 | TCCTGTTTTAATATATGCCA | 21 | 1374 |
| 1249580 | N/A | N/A | 189806 | 189825 | TAGCTTTTTCATTATAGTAA | 21 | 1375 |
| 1249606 | N/A | N/A | 191229 | 191248 | TCATATTTCCACTTACTCTA | 34 | 1376 |
| 1249632 | N/A | N/A | 200022 | 200041 | TGTTTTTTCATCATTACCAA | 18 | 1377 |
| 1249658 | N/A | N/A | 200522 | 200541 | AGACTGCTACACATTATGTT | 61 | 1378 |
| 1249684 | N/A | N/A | 201831 | 201850 | ACAGAATAAAAACTTGGCCA | 37 | 1379 |
| 1249710 | N/A | N/A | 202879 | 202898 | TTCCATTTCCCTTAATACAT | 17 | 1380 |
| 1249736 | N/A | N/A | 203557 | 203576 | ATAACTCTCATATCAAACAT | 60 | 1381 |
| 1249762 | N/A | N/A | 204279 | 204298 | AACTGCTTACTTTCTATTAA | 79 | 1382 |
| 1249788 | N/A | N/A | 206493 | 206512 | GTGATTTTCCACATTGACTT | 16 | 1383 |
| 1249814 | N/A | N/A | 208371 | 208390 | GTACCAAACTATCTTGCTTA | 28 | 1384 |
| 1249840 | N/A | N/A | 209949 | 209968 | AATCTATTAACTATGAGTCA | 55 | 1385 |
| 1249866 | N/A | N/A | 212710 | 212729 | ATTAATTTCTTAATAATATT | 93 | 1386 |
| 1249892 | N/A | N/A | 215178 | 215197 | CTGATTTAAAAAATTGGTT | 42 | 1387 |
| 1249918 | N/A | N/A | 216958 | 216977 | TGAGAATAATATCAACACTT | 22 | 1388 |

TABLE 19-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249944 | N/A | N/A | 222572 | 222591 | ACAATCTAAATTAATACTGA | 73 | 1389 |
| 1249970 | N/A | N/A | 226410 | 226429 | ATAATTTATTCCTAAAATCA | 77 | 1390 |
| 1249996 | N/A | N/A | 230204 | 230223 | TTGTTTTAATTCTCTAGTTT | 45 | 1391 |
| 1250022 | N/A | N/A | 232903 | 232922 | ATAACATTTTAAAACCACA | 60 | 1392 |
| 1250048 | N/A | N/A | 235029 | 235048 | CTCTTTTATCCAACCACTAA | 53 | 1393 |
| 1250074 | N/A | N/A | 236628 | 236647 | ACATGTTTTTCTAATTTCCT | 30 | 1394 |
| 1250100 | N/A | N/A | 238696 | 238715 | GTACACTTATCAATTATTAC | 20 | 1395 |
| 1250126 | N/A | N/A | 241798 | 241817 | CAGTAATTCTCCTAATGAAA | 37 | 1396 |
| 1250152 | N/A | N/A | 244728 | 244747 | CTGTATTAAATAATAAGTCC | 39 | 1397 |
| 1250178 | N/A | N/A | 247452 | 247471 | CAAGAGGTAATAACACACAT | 34 | 1398 |
| 1250204 | N/A | N/A | 251582 | 251601 | TTGTTTTCCCATTTAACGCA | 18 | 1399 |
| 1250230 | 4780 | 4799 | 254148 255541 | 254167 255560 | CTTTGAACCCAGTTTTTCA | 38 | 1400 |
| 1250256 | N/A | N/A | 255511 255620 | 255530 255639 | CCTCTTTTCCTGTGTTTCAT | 26 | 1401 |
| 1250282 | N/A | N/A | 257421 | 257440 | CTGTTCTCCCATTTAAATCC | 36 | 1402 |
| 1250306 | N/A | N/A | 260014 | 260033 | AAAGCACCTCTTCTTACCTA | 69 | 1403 |

TABLE 20

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 12 | 227 |
| 1248342 | 146 | 165 | 112559 | 112578 | TCCAATGCAATTCTTCAGAA | 73 | 1404 |
| 1248368 | 561 | 580 | 170032 | 170051 | GAGATTGCTTTCCCTTTATT | 13 | 1405 |
| 1248394 | 1175 | 1194 | 183522 | 183541 | TAGTACCATTCCCATCCAAT | 14 | 1406 |
| 1248420 | 1823 | 1842 | 188632 | 188651 | TGTCATTTTTCTCTTCTTCT | 22 | 1407 |
| 1248446 | 2460 | 2479 | 204362 | 204381 | TTAGCAAATTTATACCAGCA | 17 | 1408 |
| 1248472 | 2803 | 2822 | 215432 | 215451 | AACTGACAATCCTTCCACAT | 56 | 1409 |
| 1248498† | 3831 | 3850 | 240249 | 240268 | CCTTTGCCTTCTTCTATGCT | 11 | 1410 |
| 1248524 | 4333 | 4352 | 247767 | 247786 | GAGATTCACTCCCATGATAC | 17 | 1411 |
| 1248549 | 5004 | 5023 | 259920 | 259939 | AGTTTCAGCACACATTCTCC | 30 | 1412 |
| 1248575 | 6290 | 6309 | 262818 | 262837 | TCTTGGTTTCTTTTTACTTT | 31 | 1413 |
| 1248601 | 7057 | 7076 | 263585 | 263604 | TACATGTACATTTAATGGGT | 60 | 1414 |
| 1248626 | 7342 | 7361 | 263870 | 263889 | TACTATGTCAACCTTACCAA | 77 | 1415 |

TABLE 20-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248652 | 7476 | 7495 | 264004 | 264023 | AAACTATACTTACTGTGGTA | 63 | 1416 |
| 1248677 | 7630 | 7649 | 264158 | 264177 | GCTTCACTTTACCACTGATA | 27 | 1417 |
| 1248702 | 7897 | 7916 | 264425 | 264444 | CTGAAGATACTTTTAATTTC | 52 | 1418 |
| 1248727 | 8271 | 8290 | 264799 | 264818 | CCCATATTATATCTGATACA | 35 | 1419 |
| 1248753 | 8413 | 8432 | 264941 | 264960 | ATTTCACCAACACACTACAA | 57 | 1420 |
| 1248779 | 8560 | 8579 | 265088 | 265107 | ATGATAGAAATCTACCTTTA | 65 | 1421 |
| 1248805 | 8668 | 8687 | 265196 | 265215 | CCAATACACTCTTCTTAATT | 58 | 1422 |
| 1248829 | N/A | N/A | 113406 | 113425 | GAGTCATTCCACTCTTTAAC | 63 | 1423 |
| 1248855 | N/A | N/A | 115837 | 115856 | TGCTCATTATCATCAACCAC | 51 | 1424 |
| 1248881 | N/A | N/A | 119211 | 119230 | GCTAAATTCCTATCTTCTAA | 59 | 1425 |
| 1248907 | N/A | N/A | 125398 | 125417 | CATCTTAAATTTAAATGATA | 72 | 1426 |
| 1248933 | N/A | N/A | 128492 128535 128578 | 128511 128554 128597 | AACCATAGAGCCATATTTTA | 98 | 1427 |
| 1248958 | N/A | N/A | 137451 | 137470 | GATGGCTTTTTATTACCTTA | 55 | 1428 |
| 1248984 | N/A | N/A | 142797 | 142816 | ACACTTGATTTTAATAAACA | 73 | 1429 |
| 1249010 | N/A | N/A | 145983 | 146002 | CATAATTCCTATAATTCTCA | 54 | 1430 |
| 1249036 | N/A | N/A | 146652 | 146671 | GTTCAAATCATAATCACAAA | 67 | 1431 |
| 1249062 | N/A | N/A | 150352 | 150371 | TCAAGAATTACCATTTGCTC | 59 | 1432 |
| 1249088 | N/A | N/A | 155881 | 155900 | TATGTCATAACCTCTAGTGA | 80 | 1433 |
| 1249114 | N/A | N/A | 158189 | 158208 | GTTCCATCTTCATCTTGTTC | 72 | 1434 |
| 1249140 | N/A | N/A | 163620 | 163639 | ACAAATGATTCTAATTCAAA | 69 | 1435 |
| 1249166 | N/A | N/A | 169921 | 169940 | TTATTTATAAATATTGCCCT | 32 | 1436 |
| 1249192 | N/A | N/A | 171638 | 171657 | TTATTTATTTCTAATGCTAA | 148 | 1437 |
| 1249218 | N/A | N/A | 172471 | 172490 | AGAGACTTTTAAAATCTAA | 27 | 1438 |
| 1249244 | N/A | N/A | 173289 | 173308 | CTTACAAGAATATCTACCAC | 66 | 1439 |
| 1249270 | N/A | N/A | 175252 | 175271 | TGTTTAATTTTAATATGAAC | 51 | 1440 |
| 1249296 | N/A | N/A | 176727 | 176746 | GGTCAAGTTTTTACGCTTGT | 13 | 1441 |
| 1249322 | N/A | N/A | 177540 | 177559 | AATCATGTCTATATTATTCA | 26 | 1442 |
| 1249348 | N/A | N/A | 178230 | 178249 | TGCTAATTACTTACTCCTTT | 25 | 1443 |
| 1249374 | N/A | N/A | 179082 | 179101 | AAACTTTTCCACATTGAGAC | 43 | 1444 |
| 1249400 | N/A | N/A | 180016 | 180035 | TTGACATTAAAAAACAGCAA | 39 | 1445 |
| 1249426 | N/A | N/A | 180776 | 180795 | CACTACCATGCCTTCACCAC | 33 | 1446 |
| 1249452 | N/A | N/A | 182322 | 182341 | GGGTTCACACACAAACACAA | 17 | 1447 |
| 1249478 | N/A | N/A | 183890 | 183909 | GACTTATTTATTAAAATGAC | 55 | 1448 |
| 1249504 | N/A | N/A | 184855 | 184874 | ATTGAACAAATATCAATATA | 62 | 1449 |
| 1249530 | N/A | N/A | 185655 | 185674 | TTGAGCGATCTAAATAGCTA | 27 | 1450 |

TABLE 20-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249556 | N/A | N/A | 187159 | 187178 | CTGACCTCAACATTTAGGTT | 35 | 1451 |
| 1249582 | N/A | N/A | 189873 | 189892 | AAGATCATAATAACTTTTTC | 75 | 1452 |
| 1249608 | N/A | N/A | 191236 | 191255 | AAACAATTCATATTTCCACT | 28 | 1453 |
| 1249634 | N/A | N/A | 200069 | 200088 | AATGATACAATATCAAGTCA | 34 | 1454 |
| 1249660 | N/A | N/A | 200605 | 200624 | AACACATTTAACATATGGCA | 21 | 1455 |
| 1249686 | N/A | N/A | 202206 | 202225 | CACTACTGCTTCATTAAGCA | 33 | 1456 |
| 1249712 | N/A | N/A | 202885 | 202904 | GTTTGTTTCCATTTCCCTTA | 18 | 1457 |
| 1249738 | N/A | N/A | 203592 | 203611 | TCATGGTAAACATTTATTTA | 47 | 1458 |
| 1249764 | N/A | N/A | 204785 | 204804 | ATCTTCTAATAAATAAGCAA | 26 | 1459 |
| 1249790 | N/A | N/A | 206708 | 206727 | AAAGGAGCTTAAATTAGCAA | 37 | 1460 |
| 1249816 | N/A | N/A | 208492 | 208511 | GCTTCTTTCCTTAATAAAAT | 52 | 1461 |
| 1249842 | N/A | N/A | 210037 | 210056 | CAACATATTTACAATAGTGC | 15 | 1462 |
| 1249868 | N/A | N/A | 212791 | 212810 | GTCAGTTCATCAATTTCTAC | 19 | 1463 |
| 1249894 | N/A | N/A | 215499 | 215518 | GACTAATTAATTACAAAGTA | 56 | 1464 |
| 1249920 | N/A | N/A | 217027 | 217046 | CTCATTATTTTTAAAAGGCC | 18 | 1465 |
| 1249946 | N/A | N/A | 222608 | 222627 | ATTATTTTATAAACTATATC | 76 | 1466 |
| 1249972 | N/A | N/A | 226988 | 227007 | ACTATTATCACTATTTGCTT | 25 | 1467 |
| 1249998 | N/A | N/A | 230339 | 230358 | ATGATGTTTCTTACTACTTT | 20 | 1468 |
| 1250024 | N/A | N/A | 232977 | 232996 | GTAAAATCAAAATAATTACT | 77 | 1469 |
| 1250050 | N/A | N/A | 235246 | 235265 | ATACCTTTTCCTAAAGCCA | 18 | 1470 |
| 1250076 | N/A | N/A | 236690 | 236709 | AAAAATAATCCTAATATCTT | 77 | 1471 |
| 1250102 | N/A | N/A | 239772 | 239791 | AAAGATTTCATAATATTTCT | 52 | 1472 |
| 1250128 | N/A | N/A | 242844 | 242863 | AGCTGCTTCTCTCTACATCA | 36 | 1473 |
| 1250154 | N/A | N/A | 244835 | 244854 | ATAAATCTCCTTTCTATTCC | 80 | 1474 |
| 1250180 | N/A | N/A | 247615 | 247634 | TACTTATTTTAAACATTAT | 75 | 1475 |
| 1250206 | N/A | N/A | 252010 | 252029 | AAGGATTATTTAACTATTTT | 64 | 1476 |
| 1250232 | 4782 | 4801 | 254150 255543 | 254169 255562 | TTCTTTGAACCCAGTTTTTT | 36 | 1477 |
| 1250258 | N/A | N/A | 255513 255622 | 255532 255641 | TCCCTCTTTTCCTGTGTTTC | 26 | 1478 |
| 1250284 | N/A | N/A | 257537 | 257556 | GGTCTTAATTTTAATATCAC | 27 | 1479 |
| 1250308 | N/A | N/A | 260417 | 260436 | TTCCAATTATTTAAGAGGTC | 39 | 1480 |

TABLE 21

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 14 | 227 |
| 1248343 | 155 | 174 | 112568 | 112587 | ATAACAGTCTCCAATGCAAT | 59 | 1481 |
| 1248369 | 563 | 582 | 170034 | 170053 | GAGAGATTGCTTTCCCTTTA | 8 | 1482 |
| 1248395 | 1176 | 1195 | 183523 | 183542 | GTAGTACCATTCCCATCCAA | 16 | 1483 |
| 1248421 | 1824 | 1843 | 188633 | 188652 | CTGTCATTTTCTCTTCTTC | 24 | 1484 |
| 1248447 | 2461 | 2480 | 204363 | 204382 | ATTAGCAAATTTATACCAGC | 5 | 1485 |
| 1248473 | 2805 | 2824 | 215434 | 215453 | AGAACTGACAATCCTTCCAC | 50 | 1486 |
| 1248499† | 3842 | 3861 | 240260 | 240279 | ACCAGAGTTTCCCTTTGCCT | 3 | 1487 |
| 1248525 | 4367 | 4386 | 247801 | 247820 | TGTAATTAATACAATGGTAA | 27 | 1488 |
| 1248550 | 5887 | 5906 | 262415 | 262434 | TCGAAGGGCATCCATCTCTC | 47 | 1489 |
| 1248576 | 6291 | 6310 | 262819 | 262838 | TTCTTGGTTTCTTTTTACTT | 29 | 1490 |
| 1248602 | 7185 | 7204 | 263713 | 263732 | TATCAAAAATGTGATAGTCA | 53 | 1491 |
| 1248627 | 7352 | 7371 | 263880 | 263899 | AATTGACATATACTATGTCA | 41 | 1492 |
| 1248653 | 7480 | 7499 | 264008 | 264027 | TTGCAAACTATACTTACTGT | 48 | 1493 |
| 1248678 | 7631 | 7650 | 264159 | 264178 | TGCTTCACTTTACCACTGAT | 26 | 1494 |
| 1248703 | 7908 | 7927 | 264436 | 264455 | GTGACATCCACCTGAAGATA | 71 | 1495 |
| 1248728 | 8272 | 8291 | 264800 | 264819 | TCCCATATTATATCTGATAC | 25 | 1496 |
| 1248754 | 8415 | 8434 | 264943 | 264962 | GCATTTCACCAACACACTAC | 26 | 1497 |
| 1248780 | 8561 | 8580 | 265089 | 265108 | CATGATAGAAATCTACCTTT | 69 | 1498 |
| 1248806 | 8670 | 8689 | 265198 | 265217 | ATCCAATACACTCTTCTTAA | 51 | 1499 |
| 1248830 | N/A | N/A | 113497 | 113516 | GTTATTCTAATAATAATCAA | 97 | 1500 |
| 1248856 | N/A | N/A | 115905 | 115924 | ATACTTCATCTTACAAACAA | 70 | 1501 |
| 1248882 | N/A | N/A | 121980 | 121999 | TTTTATAACACTAATATGCA | 80 | 1502 |
| 1248908 | N/A | N/A | 125404 | 125423 | TTTGTTCATCTTAAATTTAA | 82 | 1503 |
| 1248934 | N/A | N/A | 128494 128537 128580 | 128513 128556 128599 | TAAACCATAGAGCCATATTT | 71 | 1504 |
| 1248959 | N/A | N/A | 139041 | 139060 | AAGTTCAAAATCATATTCTT | 76 | 1505 |
| 1248985 | N/A | N/A | 143393 | 143412 | GATACATATTTAAATTACAA | 72 | 1506 |
| 1249011 | N/A | N/A | 145985 | 146004 | ACCATAATTCCTATAATTCT | 72 | 1507 |
| 1249037 | N/A | N/A | 146782 | 146801 | ATTTTTCTCACTCCCAACCA | 63 | 1508 |
| 1249063 | N/A | N/A | 150453 | 150472 | ATTAAATATTCCTTTGCTT | 71 | 1509 |
| 1249089 | N/A | N/A | 155899 | 155918 | CCTCTCTCTCTCATACACTA | 57 | 1510 |
| 1249115 | N/A | N/A | 158194 | 158213 | CCCTGGTTCCATCTTCATCT | 72 | 1511 |
| 1249141 | N/A | N/A | 163641 | 163660 | AGCAATATACCAACTTGTTA | 69 | 1512 |
| 1249167 | N/A | N/A | 170174 | 170193 | GCTCAATAACTTGGTCAAAG | 7 | 1513 |
| 1249193 | N/A | N/A | 171686 | 171705 | TAGATCATAATTTATAATCA | 44 | 1514 |

TABLE 21-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249219 | N/A | N/A | 172472 | 172491 | TAGAGACTTTTAAAATCTA | 37 | 1515 |
| 1249245 | N/A | N/A | 173376 | 173395 | TTCTTCTTCCAAACACACAC | 25 | 1516 |
| 1249271 | N/A | N/A | 175253 | 175272 | TTGTTTAATTTTAATATGAA | 85 | 1517 |
| 1249297 | N/A | N/A | 176728 | 176747 | GGGTCAAGTTTTTACGCTTG | 6 | 1518 |
| 1249323 | N/A | N/A | 177580 | 177599 | ATGATCTTCTCAACTACTCT | 23 | 1519 |
| 1249349 | N/A | N/A | 178233 | 178252 | TCCTGCTAATTACTTACTCC | 14 | 1520 |
| 1249375 | N/A | N/A | 179155 | 179174 | AACTTATTTTCTACTTTACA | 60 | 1521 |
| 1249401 | N/A | N/A | 180073 | 180092 | TGGTTTCACCCTATCCCACT | 10 | 1522 |
| 1249427 | N/A | N/A | 180778 | 180797 | TGCACTACCATGCCTTCACC | 20 | 1523 |
| 1249453 | N/A | N/A | 183580 | 183599 | TTACTTTTATCCTCAATATA | 49 | 1524 |
| 1249479 | N/A | N/A | 183896 | 183915 | ACTACTGACTTATTTATTAA | 56 | 1525 |
| 1249505 | N/A | N/A | 184866 | 184885 | TTTTTCACAATATTGAACAA | 54 | 1526 |
| 1249531 | N/A | N/A | 185678 | 185697 | ATAATAACAATTACAAGCAC | 65 | 1527 |
| 1249557 | N/A | N/A | 187239 | 187258 | AATAACTTCTTAATAACCAA | 55 | 1528 |
| 1249583 | N/A | N/A | 189876 | 189895 | TCAAAGATCATAATAACTTT | 51 | 1529 |
| 1249609 | N/A | N/A | 191337 | 191356 | TTTCAAAAAAATCCAGATTA | 64 | 1530 |
| 1249635 | N/A | N/A | 200099 | 200118 | ATTTTACTGTTATTTAGTAA | 65 | 1531 |
| 1249661 | N/A | N/A | 200612 | 200631 | ACAAATTAACACATTTAACA | 86 | 1532 |
| 1249687 | N/A | N/A | 202217 | 202236 | TTTTGCTTATCCACTACTGC | 23 | 1533 |
| 1249713 | N/A | N/A | 202887 | 202906 | CAGTTTGTTTCCATTTCCCT | 10 | 1534 |
| 1249739 | N/A | N/A | 203609 | 203628 | ATATAATTCATACATTTTCA | 64 | 1535 |
| 1249765 | N/A | N/A | 204849 | 204868 | AGGTTCTTAAAAATATGTCA | 26 | 1536 |
| 1249791 | N/A | N/A | 206733 | 206752 | TGCTATTCTTTATCTAGTTT | 22 | 1537 |
| 1249817 | N/A | N/A | 208495 | 208514 | AAGGCTTCTTTCCTTAATAA | 21 | 1538 |
| 1249843 | N/A | N/A | 210042 | 210061 | TTGCTCAACATATTTACAAT | 29 | 1539 |
| 1249869 | N/A | N/A | 212792 | 212811 | AGTCAGTTCATCAATTTCTA | 20 | 1540 |
| 1249895 | N/A | N/A | 215502 | 215521 | GAAGACTAATTAATTACAAA | 43 | 1541 |
| 1249921 | N/A | N/A | 217110 | 217129 | TTTTGTTTCTCCTTAAGGAA | 46 | 1542 |
| 1249947 | N/A | N/A | 222612 | 222631 | AATGATTATTTTATAAACTA | 96 | 1543 |
| 1249973 | N/A | N/A | 227094 | 227113 | GTTCTTGACACCTTATTTTA | 28 | 1544 |
| 1249999 | N/A | N/A | 230394 | 230413 | CCTCATTTTTCTTTAATTA | 34 | 1545 |
| 1250025 | N/A | N/A | 233210 | 233229 | TAACTTCCTATTAAATTTTT | 81 | 1546 |
| 1250051 | N/A | N/A | 235281 | 235300 | TTAGTGCACTACCTTAGTTC | 30 | 1547 |
| 1250077 | N/A | N/A | 236707 | 236726 | GTATATCAAATTACTAGAAA | 58 | 1548 |
| 1250103 | N/A | N/A | 239809 | 239828 | CTATTTCCCATCTTTATTAT | 53 | 1549 |
| 1250129 | N/A | N/A | 242906 | 242925 | GTAATTTTTAAATTTTGGTC | 45 | 1550 |

TABLE 21-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250155 | N/A | N/A | 244845 | 244864 | TGATCTCTAAATAAATCTCC | 76 | 1551 |
| 1250181 | N/A | N/A | 247616 | 247635 | TTACTTATTTTTAAACATTA | 71 | 1552 |
| 1250207 | N/A | N/A | 252011 | 252030 | AAAGGATTATTTAACTATTT | 54 | 1553 |
| 1250233 | 4783 | 4802 | 254151<br>255544 | 254170<br>255563 | TTTCTTTGAACCCAGTTTTT | 36 | 1554 |
| 1250259 | N/A | N/A | 255514<br>255623 | 255533<br>255642 | CTCCCTCTTTTCCTGTGTTT | 37 | 1555 |
| 1250285 | N/A | N/A | 257829 | 257848 | GTTTATCTGTCTACTATTCT | 50 | 1556 |
| 1250309 | N/A | N/A | 260619 | 260638 | ATCTTTTGCATTCCTAGGAC | 36 | 1557 |

TABLE 22

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 15 | 227 |
| 1248341 | 145 | 164 | 112558 | 112577 | CCAATGCAATTCTTCAGAAT | 40 | 1558 |
| 1248367 | 560 | 579 | 170031 | 170050 | AGATTGCTTTCCCTTTATTC | 16 | 1559 |
| 1248393 | 1172 | 1191 | 183519 | 183538 | TACCATTCCCATCCAATGAA | 17 | 1560 |
| 1248419 | 1821 | 1840 | 188630 | 188649 | TCATTTTCTCTTCTTCTCC | 32 | 1561 |
| 1248445 | 2459 | 2478 | 204361 | 204380 | TAGCAAATTTATACCAGCAT | 9 | 1562 |
| 1248471 | 2801 | 2820 | 215430 | 215449 | CTGACAATCCTTCCACATTT | 39 | 1563 |
| 1248497† | 3830 | 3849 | 240248 | 240267 | CTTTGCCTTCTTCTATGCTT | 3 | 1564 |
| 1248523 | 4320 | 4339 | 247754 | 247773 | ATGATACTGAATATTAGCCA | 10 | 1565 |
| 1248548 | 4944 | 4963 | 259860 | 259879 | ATGTTTGTCATTTCTTGACT | 19 | 1566 |
| 1248574 | 6286 | 6305 | 262814 | 262833 | GGTTTCTTTTACTTTTTAC | 19 | 1567 |
| 1248600 | 7056 | 7075 | 263584 | 263603 | ACATGTACATTTAATGGGTT | 63 | 1568 |
| 1248625 | 7338 | 7357 | 263866 | 263885 | ATGTCAACCTTACCAAGAGC | 33 | 1569 |
| 1248651 | 7440 | 7459 | 263968 | 263987 | AGTAGTGTGCTTAAATCATC | 29 | 1570 |
| 1248676 | 7628 | 7647 | 264156 | 264175 | TTCACTTTACCACTGATATA | 52 | 1571 |
| 1248701 | 7896 | 7915 | 264424 | 264443 | TGAAGATACTTTTAATTTCT | 40 | 1572 |
| 1248726 | 8231 | 8250 | 264759 | 264778 | AATAAGATCTATCTGTGTAA | 40 | 1573 |
| 1248752 | 8411 | 8430 | 264939 | 264958 | TTCACCAACACACTACAAGT | 53 | 1574 |
| 1248778 | 8559 | 8578 | 265087 | 265106 | TGATAGAAATCTACCTTTAA | 62 | 1575 |
| 1248804 | 8667 | 8686 | 265195 | 265214 | CAATACACTCTTCTTAATTA | 75 | 1576 |
| 1248828 | N/A | N/A | 113400 | 113419 | TTCCACTCTTTAACACAGAT | 59 | 1577 |
| 1248854 | N/A | N/A | 115793 | 115812 | GCATTTTCAAACCTTCCTTC | 61 | 1578 |

TABLE 22-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248880 | N/A | N/A | 119139 | 119158 | TAATTTGAATCCATATTTTA | 89 | 1579 |
| 1248906 | N/A | N/A | 125320 | 125339 | TGATATATTTATACTAGTTA | 72 | 1580 |
| 1248932 | N/A | N/A | 128491 128534 128577 | 128510 128553 128596 | ACCATAGAGCCATATTTTAA | 67 | 1581 |
| 1248957 | N/A | N/A | 134774 | 134793 | TCCTTTTTTTTAACCATCTA | 62 | 1582 |
| 1248983 | N/A | N/A | 142796 | 142815 | CACTTGATTTTAATAAACAT | 63 | 1583 |
| 1249009 | N/A | N/A | 145961 | 145980 | CTTCAGTCTACATTTTGCCC | 52 | 1584 |
| 1249035 | N/A | N/A | 146646 | 146665 | ATCATAATCACAAATTATAA | 79 | 1585 |
| 1249061 | N/A | N/A | 150330 | 150349 | ATAAGCTCTTTAACATTTTA | 70 | 1586 |
| 1249087 | N/A | N/A | 155833 | 155852 | TTGGATCCAATCATTTCTCA | 75 | 1587 |
| 1249113 | N/A | N/A | 158161 | 158180 | TGACCAACATTCTTTAGATA | 79 | 1588 |
| 1249139 | N/A | N/A | 163516 | 163535 | TCTACTTTTTTAATAAAAA | 93 | 1589 |
| 1249165 | N/A | N/A | 169893 | 169912 | GTGTATAACATAATAATTAC | 22 | 1590 |
| 1249191 | N/A | N/A | 171609 | 171628 | ATCTTTTCCCCACATGCTA | 32 | 1591 |
| 1249217 | N/A | N/A | 172396 | 172415 | ATCAACAGCTCAACTTGGCA | 14 | 1592 |
| 1249243 | N/A | N/A | 173288 | 173307 | TTACAAGAATATCTACCACA | 96 | 1593 |
| 1249269 | N/A | N/A | 175236 | 175255 | GAACAAACTCCTATTTGCCA | 15 | 1594 |
| 1249295 | N/A | N/A | 176726 | 176745 | GTCAAGTTTTACGCTTGTG | 15 | 1595 |
| 1249321 | N/A | N/A | 177530 | 177549 | ATATTATTCACCATTATAGC | 23 | 1596 |
| 1249347 | N/A | N/A | 178167 | 178186 | CCTATGAGAAATCTTAGATT | 24 | 1597 |
| 1249373 | N/A | N/A | 178822 | 178841 | GCCTTATCTCCCTTTTCCAT | 28 | 1598 |
| 1249399 | N/A | N/A | 179990 | 180009 | AAAACCAAAACAACTATTTA | 69 | 1599 |
| 1249425 | N/A | N/A | 180775 | 180794 | ACTACCATGCCTTCACCACC | 21 | 1600 |
| 1249451 | N/A | N/A | 182143 | 182162 | GTAGAATTAAATCAGAGTTA | 31 | 1601 |
| 1249477 | N/A | N/A | 183854 | 183873 | TGTCTACCAAATAAACATTT | 34 | 1602 |
| 1249503 | N/A | N/A | 184852 | 184871 | GAACAAATATCAATATATAA | 79 | 1603 |
| 1249529 | N/A | N/A | 185640 | 185659 | AGCTATACATTTATTAATCC | 14 | 1604 |
| 1249555 | N/A | N/A | 186607 | 186626 | ACACTGGCTATAATTAGGTT | 76 | 1605 |
| 1249581 | N/A | N/A | 189864 | 189883 | ATAACTTTTCTATTGCTAT | 36 | 1606 |
| 1249607 | N/A | N/A | 191230 | 191249 | TTCATATTTCCACTTACTCT | 32 | 1607 |
| 1249633 | N/A | N/A | 200026 | 200045 | GAAGTGTTTTTTCATCATTA | 9 | 1608 |
| 1249659 | N/A | N/A | 200553 | 200572 | CCAAAGTCTTTATTTTGGCA | 12 | 1609 |
| 1249685 | N/A | N/A | 201862 | 201881 | GTCAGTTTTCATTCTAGATA | 7 | 1610 |
| 1249711 | N/A | N/A | 202881 | 202900 | GTTTCCATTTCCCTTAATAC | 8 | 1611 |
| 1249737 | N/A | N/A | 203585 | 203604 | AAACATTTATTTAAATGTAT | 85 | 1612 |
| 1249763 | N/A | N/A | 204697 | 204716 | TTTTTGTTATTTAAAAGGGA | 65 | 1613 |

TABLE 22-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249789 | N/A | N/A | 206546 | 206565 | TCTTATTGACTCATTGGTTA | 23 | 1614 |
| 1249815 | N/A | N/A | 208460 | 208479 | TTGTTGAAAATTAATTTAAC | 68 | 1615 |
| 1249841 | N/A | N/A | 210003 | 210022 | TTTGTTTATTCTAACAATTT | 70 | 1616 |
| 1249867 | N/A | N/A | 212761 | 212780 | TGTGACATTTTTACTGGGAT | 12 | 1617 |
| 1249893 | N/A | N/A | 215215 | 215234 | GCAACTTAATTTACTCCCAA | 11 | 1618 |
| 1249919 | N/A | N/A | 217026 | 217045 | TCATTATTTTAAAAGGCCA | 27 | 1619 |
| 1249945 | N/A | N/A | 222578 | 222597 | TACATCACAATCTAAATTAA | 85 | 1620 |
| 1249971 | N/A | N/A | 226415 | 226434 | CACTGATAATTTATTCCTAA | 42 | 1621 |
| 1249997 | N/A | N/A | 230321 | 230340 | TTGTGATATTTAACAATGTA | 12 | 1622 |
| 1250023 | N/A | N/A | 232975 | 232994 | AAAATCAAAATAATTACTCA | 73 | 1623 |
| 1250049 | N/A | N/A | 235244 | 235263 | ACCTTTTTCCTAAAGCCAAA | 27 | 1624 |
| 1250075 | N/A | N/A | 236686 | 236705 | ATAATCCTAATATCTTTGTC | 28 | 1625 |
| 1250101 | N/A | N/A | 239406 | 239425 | GTTTGCTTTAAATCTGGCCA | 16 | 1626 |
| 1250127 | N/A | N/A | 242772 | 242791 | TGGAATGCATCCTCTAGTAA | 39 | 1627 |
| 1250153 | N/A | N/A | 244751 | 244770 | ATGTAATTCTTCAATAGCTT | 19 | 1628 |
| 1250179 | N/A | N/A | 247606 | 247625 | TTAAACATTATTAAAAGAAC | 111 | 1629 |
| 1250205 | N/A | N/A | 251855 | 251874 | CTGATGCAATTTACTAATTA | 40 | 1630 |
| 1250231 | 4781 | 4800 | 254149 255542 | 254168 255561 | TCTTTGAACCCAGTTTTTTC | 27 | 1631 |
| 1250257 | N/A | N/A | 255512 255621 | 255531 255640 | CCCTCTTTTCCTGTGTTTCA | 19 | 1632 |
| 1250283 | N/A | N/A | 257536 | 257555 | GTCTTAATTTTAATATCACC | 19 | 1633 |
| 1250307 | N/A | N/A | 260292 | 260311 | GTACAAGACTATTCTACCAA | 41 | 1634 |

TABLE 23

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 18 | 227 |
| 1248344 | 156 | 175 | 112569 | 112588 | TATAACAGTCTCCAATGCAA | 83 | 1635 |
| 1248370 | 564 | 583 | 170035 | 170054 | CGAGAGATTGCTTTCCCTTT | 15 | 1636 |
| 1248396 | 1178 | 1197 | 183525 | 183544 | AAGTAGTACCATTCCCATCC | 10 | 1637 |
| 1248422 | 1828 | 1847 | 188637 | 188656 | GACTCTGTCATTTTCTCTT | 23 | 1638 |
| 1248448 | 2463 | 2482 | 204365 | 204384 | ATATTAGCAAATTTATACCA | 48 | 1639 |
| 1248474 | 3021 | 3040 | 217735 | 217754 | GGGAGTTCACAATCATTGGA | 24 | 1640 |

TABLE 23-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248500† | 3853 | 3872 | 240271 | 240290 | CCTCAAATTCCACCAGAGTT | 7 | 1641 |
| 1248526 | 4368 | 4387 | 247802 | 247821 | GTGTAATTAATACAATGGTA | 15 | 1642 |
| 1248551 | 5949 | 5968 | 262477 | 262496 | GTAATGGGCTCATAAGAGAC | 55 | 1643 |
| 1248577 | 6347 | 6366 | 262875 | 262894 | TTGACACAAACACATCACCA | 36 | 1644 |
| 1248603 | 7189 | 7208 | 263717 | 263736 | CACTTATCAAAAATGTGATA | 61 | 1645 |
| 1248628 | 7353 | 7372 | 263881 | 263900 | AAATTGACATATACTATGTC | 103 | 1646 |
| 1248654 | 7483 | 7502 | 264011 | 264030 | AGCTTGCAAACTATACTTAC | 35 | 1647 |
| 1248679 | 7632 | 7651 | 264160 | 264179 | TTGCTTCACTTTACCACTGA | 30 | 1648 |
| 1248704 | 7929 | 7948 | 264457 | 264476 | CAGAAACTAACAATAGTGAC | 53 | 1649 |
| 1248729 | 8273 | 8292 | 264801 | 264820 | ATCCCATATTATATCTGATA | 35 | 1650 |
| 1248755 | 8416 | 8435 | 264944 | 264963 | TGCATTTCACCAACACACTA | 34 | 1651 |
| 1248781 | 8570 | 8589 | 265098 | 265117 | TTATTTTTACATGATAGAAA | 71 | 1652 |
| 1248807 | 8674 | 8693 | 265202 | 265221 | AGTTATCCAATACACTCTTC | 49 | 1653 |
| 1248831 | N/A | N/A | 113499 | 113518 | CTGTTATTCTAATAATAATC | 70 | 1654 |
| 1248857 | N/A | N/A | 116126 | 116145 | AACCTGTTTTTAAATAGGTG | 79 | 1655 |
| 1248883 | N/A | N/A | 121986 | 122005 | GTTTGATTTTATAACACTAA | 57 | 1656 |
| 1248909 | N/A | N/A | 125406 | 125425 | GTTTTGTTCATCTTAAATTT | 79 | 1657 |
| 1248935 | N/A | N/A | 128496 128539 128582 | 128515 128558 128601 | GTTAAACCATAGAGCCATAT | 61 | 1658 |
| 1248960 | N/A | N/A | 139439 | 139458 | TACTCATCTTCATCTTCTTT | 73 | 1659 |
| 1248986 | N/A | N/A | 143428 | 143447 | ATTATAAATTATCAATGTTA | 73 | 1660 |
| 1249012 | N/A | N/A | 146106 | 146125 | CCAAAATGTTTATTTAGCAT | 63 | 1661 |
| 1249038 | N/A | N/A | 147189 | 147208 | TTAATATTATTAAATATCAA | 107 | 1662 |
| 1249064 | N/A | N/A | 151067 | 151086 | GTTTAAATCTCAAATACATT | 63 | 1663 |
| 1249090 | N/A | N/A | 155932 | 155951 | GGTGAAAAACCTTACAGCCA | 61 | 1664 |
| 1249116 | N/A | N/A | 158348 | 158367 | CAATTGTTCCATCTTTGTCA | 78 | 1665 |
| 1249142 | N/A | N/A | 163695 | 163714 | GTGTCAACTTCAATTATCAA | 50 | 1666 |
| 1249168 | N/A | N/A | 170176 | 170195 | TAGCTCAATAACTTGGTCAA | 24 | 1667 |
| 1249194 | N/A | N/A | 171689 | 171708 | TAATAGATCATAATTTATAA | 79 | 1668 |
| 1249220 | N/A | N/A | 172505 | 172524 | ACATCTGAAATATAACACTT | 58 | 1669 |
| 1249246 | N/A | N/A | 173377 | 173396 | TTTCTTCTTCCAAACACACA | 58 | 1670 |
| 1249272 | N/A | N/A | 175319 | 175338 | CAGTGCATATTTCTGAGCCA | 15 | 1671 |
| 1249298 | N/A | N/A | 176730 | 176749 | TAGGGTCAAGTTTTTACGCT | 11 | 1672 |
| 1249324 | N/A | N/A | 177583 | 177602 | ATGATGATCTTCTCAACTAC | 29 | 1673 |
| 1249350 | N/A | N/A | 178247 | 178266 | ATCTACCCCTCCATTCCTGC | 45 | 1674 |
| 1249376 | N/A | N/A | 179219 | 179238 | AATATTCTCCACTTTCCTCC | 34 | 1675 |

TABLE 23-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249402 | N/A | N/A | 180164 | 180183 | CTCCTTCAACTTAATGGCCC | 14 | 1676 |
| 1249428 | N/A | N/A | 180779 | 180798 | ATGCACTACCATGCCTTCAC | 11 | 1677 |
| 1249454 | N/A | N/A | 183583 | 183602 | ATCTTACTTTTATCCTCAAT | 30 | 1678 |
| 1249480 | N/A | N/A | 183968 | 183987 | AACCAAATAGGGCCAAATTA | 38 | 1679 |
| 1249506 | N/A | N/A | 184869 | 184888 | AGATTTTTCACAATATTGAA | 48 | 1680 |
| 1249532 | N/A | N/A | 185688 | 185707 | CATGATCCCAATAATAACAA | 33 | 1681 |
| 1249558 | N/A | N/A | 187243 | 187262 | AAGTAATAACTTCTTAATAA | 78 | 1682 |
| 1249584 | N/A | N/A | 189912 | 189931 | ATTTGAATACCAACAACCCT | 43 | 1683 |
| 1249610 | N/A | N/A | 191393 | 191412 | CTTATCACAAATAAATAATA | 82 | 1684 |
| 1249636 | N/A | N/A | 200126 | 200145 | ATAATAGAATCCATGAGTTA | 76 | 1685 |
| 1249662 | N/A | N/A | 200617 | 200636 | AAGTCACAAATTAACACATT | 70 | 1686 |
| 1249688 | N/A | N/A | 202385 | 202404 | GGGTTATCCACATAGAATCA | 31 | 1687 |
| 1249714 | N/A | N/A | 202947 | 202966 | ATTTCCACTAAAAATAGATT | 60 | 1688 |
| 1249740 | N/A | N/A | 203612 | 203631 | TACATATAATTCATACATTT | 60 | 1689 |
| 1249766 | N/A | N/A | 205035 | 205054 | TCTAAATTAATATTGCTAA | 67 | 1690 |
| 1249792 | N/A | N/A | 206885 | 206904 | GTGTCTTTCCTCTTTTTTTC | 13 | 1691 |
| 1249818 | N/A | N/A | 208552 | 208571 | GTTCAATTCCATTCTTTCAT | 22 | 1692 |
| 1249844 | N/A | N/A | 210056 | 210075 | TTTTTTCCTTTAAATTGCTC | 49 | 1693 |
| 1249870 | N/A | N/A | 213035 | 213054 | AAACACTTCCTTTCTTCTAT | 48 | 1694 |
| 1249896 | N/A | N/A | 215503 | 215522 | TGAAGACTAATTAATTACAA | 84 | 1695 |
| 1249922 | N/A | N/A | 217302 | 217321 | GATGAATTATTTATTTGTCA | 24 | 1696 |
| 1249948 | N/A | N/A | 222759 | 222778 | ATATATGACTACCTTAGCTA | 61 | 1697 |
| 1249974 | N/A | N/A | 227123 | 227142 | TTGCTTTCCATCATTAGTTT | 43 | 1698 |
| 1250000 | N/A | N/A | 230617 | 230636 | AAGGAATTACATTAATATAA | 54 | 1699 |
| 1250026 | N/A | N/A | 233213 | 233232 | ACATAACTTCCTATTAAATT | 75 | 1700 |
| 1250052 | N/A | N/A | 235333 | 235352 | TCTTATTTAAATCACATTAA | 75 | 1701 |
| 1250078 | N/A | N/A | 236728 | 236747 | TTTCTTATTTTAATTTATCA | 79 | 1702 |
| 1250104 | N/A | N/A | 239810 | 239829 | ACTATTTCCCATCTTTATTA | 47 | 1703 |
| 1250130 | N/A | N/A | 243053 | 243072 | ATGATTTCTTAAAAAAGGAA | 70 | 1704 |
| 1250156 | N/A | N/A | 246375 | 246394 | CTGCTCTCAATAATAATTCT | 25 | 1705 |
| 1250182 | N/A | N/A | 247629 | 247648 | CAACAACAAATATTTACTTA | 62 | 1706 |
| 1250208 | N/A | N/A | 252051 | 252070 | TTAACTTTCTCAAATAATGT | 75 | 1707 |
| 1250234 | 4784 | 4803 | 254152 255545 | 254171 255564 | GTTTCTTTGAACCCAGTTTT | 20 | 1708 |
| 1250260 | N/A | N/A | 255515 255624 | 255534 255643 | CCTCCCTCTTTTCCTGTGTT | 30 | 1709 |

TABLE 23-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250286 | N/A | N/A | 257905 | 257924 | CTTACTTCCACCCTCTGATA | 65 | 1710 |
| 1250310 | N/A | N/A | 260671 | 260690 | CTCATTTAATATCTTATACA | 63 | 1711 |

TABLE 24

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 14 | 227 |
| 1248345 | 161 | 180 | 112574 | 112593 | TTGAATATAACAGTCTCCAA | 60 | 1712 |
| 1248371 | 565 | 584 | 170036 | 170055 | TCGAGAGATTGCTTTCCCTT | 12 | 1713 |
| 1248397 | 1179 | 1198 | 183526 | 183545 | AAAGTAGTACCATTCCCATC | 26 | 1714 |
| 1248423 | 1830 | 1849 | 188639 | 188658 | CGGACTCTGTCATTTTTCTC | 22 | 1715 |
| 1248449 | 2473 | 2492 | 204375 | 204394 | AATCAAACACATATTAGCAA | 20 | 1716 |
| 1248475 | 3292 | 3311 | 227286 | 227305 | CTGCATCCTTCCCACAGCAA | 16 | 1717 |
| 1248501† | 3858 | 3877 | 240276 | 240295 | GTTTTCCTCAAATTCCACCA | 10 | 1718 |
| 1248527 | 4369 | 4388 | 247803 | 247822 | GGTGTAATTAATACAATGGT | 23 | 1719 |
| 1248552 | 6033 | 6052 | 262561 | 262580 | ACTTTTTGCTTCAAGAGGTA | 71 | 1720 |
| 1248578 | 6406 | 6425 | 262934 | 262953 | CCTTAAGTATACATTTGTAA | 65 | 1721 |
| 1248604 | 7191 | 7210 | 263719 | 263738 | GACACTTATCAAAAATGTGA | 31 | 1722 |
| 1248629 | 7357 | 7376 | 263885 | 263904 | TTTTAAATTGACATATACTA | 75 | 1723 |
| 1248655 | 7484 | 7503 | 264012 | 264031 | AAGCTTGCAAACTATACTTA | 44 | 1724 |
| 1248680 | 7634 | 7653 | 264162 | 264181 | ATTTGCTTCACTTTACCACT | 38 | 1725 |
| 1248705 | 7930 | 7949 | 264458 | 264477 | ACAGAAACTAACAATAGTGA | 49 | 1726 |
| 1248730 | 8277 | 8296 | 264805 | 264824 | TGGGATCCCATATTATATCT | 61 | 1727 |
| 1248756 | 8417 | 8436 | 264945 | 264964 | ATGCATTTCACCAACACACT | 48 | 1728 |
| 1248782 | 8574 | 8593 | 265102 | 265121 | TAGATTATTTTACATGATA | 86 | 1729 |
| 1248808 | 8675 | 8694 | 265203 | 265222 | TAGTTATCCAATACACTCTT | 66 | 1730 |
| 1248832 | N/A | N/A | 113615 | 113634 | AGGCATTTAAAAACAATCTT | 58 | 1731 |
| 1248858 | N/A | N/A | 116897 | 116916 | TTATCTTTTCCTAATAGAAA | 79 | 1732 |
| 1248884 | N/A | N/A | 122656 | 122675 | TTGGTGATTTATATAAACTA | 68 | 1733 |
| 1248910 | N/A | N/A | 125522 | 125541 | TGCTCTTTTTTAAATAAAAA | 110 | 1734 |
| 1248936 | N/A | N/A | 128497 128540 | 128516 128559 | AGTTAAACCATAGAGCCATA | 77 | 1735 |
| 1248961 | N/A | N/A | 139746 | 139765 | GATTTATTTTTTACCTATTA | 86 | 1736 |
| 1248987 | N/A | N/A | 143434 | 143453 | TTAAATATTATAAATTATCA | 73 | 1737 |

TABLE 24-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249013 | N/A | N/A | 146189 | 146208 | TAGACTATTTTCACTAGTAC | 69 | 1738 |
| 1249039 | N/A | N/A | 147200 | 147219 | TCTTCTTTTTCTTAATATTA | 79 | 1739 |
| 1249065 | N/A | N/A | 151070 | 151089 | GCAGTTTAAATCTCAAATAC | 53 | 1740 |
| 1249091 | N/A | N/A | 155966 | 155985 | TTTATGTATTCAACAAATAA | 74 | 1741 |
| 1249117 | N/A | N/A | 158526 | 158545 | CTGAAAGTTTCCTTTTCCTA | 75 | 1742 |
| 1249143 | N/A | N/A | 163721 | 163740 | CAATATTTCATAAATCTCTA | 82 | 1743 |
| 1249169 | N/A | N/A | 170177 | 170196 | GTAGCTCAATAACTTGGTCA | 16 | 1744 |
| 1249195 | N/A | N/A | 171690 | 171709 | ATAATAGATCATAATTTATA | 84 | 1745 |
| 1249221 | N/A | N/A | 172534 | 172553 | CTTTTGTTATATCTCTGCTC | 25 | 1746 |
| 1249247 | N/A | N/A | 173422 | 173441 | GTAACACTTATCACTAGCTC | 53 | 1747 |
| 1249273 | N/A | N/A | 175434 | 175453 | GAGGAGTTTTTAACCTATAT | 8 | 1748 |
| 1249299 | N/A | N/A | 176732 | 176751 | ACTAGGGTCAAGTTTTTACG | 25 | 1749 |
| 1249325 | N/A | N/A | 177584 | 177603 | AATGATGATCTTCTCAACTA | 52 | 1750 |
| 1249351 | N/A | N/A | 178255 | 178274 | ATCTTTTAATCTACCCCTCC | 44 | 1751 |
| 1249377 | N/A | N/A | 179271 | 179290 | CTGTATTTTCCTACTAGGCT | 14 | 1752 |
| 1249403 | N/A | N/A | 180170 | 180189 | GTAAGTCTCCTTCAACTTAA | 13 | 1753 |
| 1249429 | N/A | N/A | 180780 | 180799 | TATGCACTACCATGCCTTCA | 19 | 1754 |
| 1249455 | N/A | N/A | 183612 | 183631 | ACTAAACAACTTAATGGTTT | 33 | 1755 |
| 1249481 | N/A | N/A | 183970 | 183989 | TCAACCAAATAGGGCCAAAT | 26 | 1756 |
| 1249507 | N/A | N/A | 184898 | 184917 | GATAAACTAATAAATATATA | 81 | 1757 |
| 1249533 | N/A | N/A | 185689 | 185708 | GCATGATCCCAATAATAACA | 20 | 1758 |
| 1249559 | N/A | N/A | 187247 | 187266 | AATAAAGTAATAACTTCTTA | 78 | 1759 |
| 1249585 | N/A | N/A | 189967 | 189986 | TCTTCATAGGCAACTTGATA | 35 | 1760 |
| 1249611 | N/A | N/A | 191396 | 191415 | TAGCTTATCACAAATAAATA | 89 | 1761 |
| 1249637 | N/A | N/A | 200160 | 200179 | GAGGCTAAATATAAAAAAAA | 75 | 1762 |
| 1249663 | N/A | N/A | 200618 | 200637 | AAAGTCACAAATTAACACAT | 34 | 1763 |
| 1249689 | N/A | N/A | 202409 | 202428 | GCCACATCTCCATTATTCCT | 36 | 1764 |
| 1249715 | N/A | N/A | 202959 | 202978 | ATTGTTTTTAAAATTTCCAC | 42 | 1765 |
| 1249741 | N/A | N/A | 203613 | 203632 | ATACATATAATTCATACATT | 88 | 1766 |
| 1249767 | N/A | N/A | 205036 | 205055 | TTCTAAATTTAATATTGCTA | 67 | 1767 |
| 1249793 | N/A | N/A | 206901 | 206920 | CTACTTCTAATAATTAGTGT | 68 | 1768 |
| 1249819 | N/A | N/A | 208582 | 208601 | CTTAATTTTATATATGTTA | 90 | 1769 |
| 1249845 | N/A | N/A | 210150 | 210169 | TGTGTACTTTTCAATTATAA | 36 | 1770 |
| 1249871 | N/A | N/A | 213230 | 213249 | GTCTGTTTTCCAATAAATTT | 28 | 1771 |
| 1249897 | N/A | N/A | 215560 | 215579 | GTGTATTCAAATAATATTAT | 38 | 1772 |
| 1249923 | N/A | N/A | 217353 | 217372 | GTAATTTTATTAACAGGGCA | 34 | 1773 |

TABLE 24-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249949 | N/A | N/A | 222886 | 222905 | GACACCTTTCCCATTTTTCC | 35 | 1774 |
| 1249975 | N/A | N/A | 227145 | 227164 | TCAAAACATTCTATTGCTTC | 99 | 1775 |
| 1250001 | N/A | N/A | 230638 | 230657 | AACAATCATTCAAAATCACA | 87 | 1776 |
| 1250027 | N/A | N/A | 233343 | 233362 | TTTCTGCTTTAATAATACTA | 31 | 1777 |
| 1250053 | N/A | N/A | 235337 | 235356 | TTTCTCTTATTTAAATCACA | 37 | 1778 |
| 1250079 | N/A | N/A | 236729 | 236748 | ATTTCTTATTTTAATTTATC | 72 | 1779 |
| 1250105 | N/A | N/A | 239907 | 239926 | GTTGGTATTTCCATCCTGTC | 35 | 1780 |
| 1250131 | N/A | N/A | 243054 | 243073 | GATGATTTCTTAAAAAAGGA | 34 | 1781 |
| 1250157 | N/A | N/A | 246378 | 246397 | AGTCTGCTCTCAATAATAAT | 49 | 1782 |
| 1250183 | N/A | N/A | 247961 | 247980 | AAGTGATTACTTACTACTTG | 47 | 1783 |
| 1250209 | N/A | N/A | 252054 | 252073 | TCTTTAACTTTCTCAAATAA | 55 | 1784 |
| 1250235 | 4785 | 4804 | 254153 255546 | 254172 255565 | GGTTTCTTTGAACCCAGTTT | 11 | 1785 |
| 1250261 | N/A | N/A | 255516 255625 | 255535 255644 | TCCTCCCTCTTTTCCTGTGT | 37 | 1786 |
| 1250287 | N/A | N/A | 258046 | 258065 | AACTAGATTTCTATTACTCC | 51 | 1787 |
| 1250311 | N/A | N/A | 260672 | 260691 | CCTCATTTAATATCTTATAC | 49 | 1788 |

TABLE 25

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910088 | 8676 | 8695 | 265204 | 265223 | GTAGTTATCCAATACACTCT | 44 | 120 |
| 910184 | N/A | N/A | 128500 128543 | 128519 128562 | TGGAGTTAAACCATAGAGCC | 78 | 136 |
| 910263 | N/A | N/A | 180777 | 180796 | GCACTACCATGCCTTCACCA | 17 | 227 |
| 1248346 | 164 | 183 | 112577 | 112596 | GTGTTGAATATAACAGTCTC | 62 | 1789 |
| 1248372 | 567 | 586 | 170038 | 170057 | AATCGAGAGATTGCTTTCCC | 24 | 1790 |
| 1248398 | 1180 | 1199 | 183527 | 183546 | GAAAGTAGTACCATTCCCAT | 17 | 1791 |
| 1248424 | 1869 | 1888 | 188678 | 188697 | AAACCTTTTCTTCTTATGCT | 28 | 1792 |
| 1248450 | 2474 | 2493 | 204376 | 204395 | AAATCAAACACATATTAGCA | 39 | 1793 |
| 1248476 | 3304 | 3323 | 227298 | 227317 | ATCGATTCCTTTCTGCATCC | 17 | 1794 |
| 1248502† | 3859 | 3878 | 240277 | 240296 | TGTTTTCCTCAAATTCCACC | 11 | 1795 |
| 1248528 | 4389 | 4408 | 247823 | 247842 | ACATCAAACATCTCTCCAGT | 32 | 1796 |
| 1248553 | 6041 | 6060 | 262569 | 262588 | CCTTTTTAACTTTTTGCTTC | 53 | 1797 |
| 1248579 | 6472 | 6491 | 263000 | 263019 | CTATTTCTCCAGTTTACTGA | 58 | 1798 |

TABLE 25-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248605 | 7192 | 7211 | 263720 | 263739 | GGACACTTATCAAAAATGTG | 40 | 1799 |
| 1248630 | 7371 | 7390 | 263899 | 263918 | AGCAGACTTTTATTTTTAA | 34 | 1800 |
| 1248656 | 7505 | 7524 | 264033 | 264052 | TTACATCATATTACCTGTTG | 36 | 1801 |
| 1248681 | 7635 | 7654 | 264163 | 264182 | AATTTGCTTCACTTTACCAC | 42 | 1802 |
| 1248706 | 7934 | 7953 | 264462 | 264481 | AGGAACAGAAACTAACAATA | 42 | 1803 |
| 1248731 | 8278 | 8297 | 264806 | 264825 | CTGGGATCCCATATTATATC | 40 | 1804 |
| 1248757 | 8418 | 8437 | 264946 | 264965 | CATGCATTTCACCAACACAC | 38 | 1805 |
| 1248783 | 8587 | 8606 | 265115 | 265134 | TTTGTTTTTCAGATAGATTA | 55 | 1806 |
| 1248833 | N/A | N/A | 113800 | 113819 | TTTTATAAAATCATTCCCCA | 71 | 1807 |
| 1248859 | N/A | N/A | 117256 | 117275 | CTTTCCTTTTCTATTTATTT | 36 | 1808 |
| 1248885 | N/A | N/A | 123302 | 123321 | GAGAGCTATTTAATAGGTC | 65 | 1809 |
| 1248911 | N/A | N/A | 125523 | 125542 | ATGCTCTTTTTAAATAAAA | 87 | 1810 |
| 1248962 | N/A | N/A | 139883 | 139902 | TGTCTTGACTTCTCTTGCAA | 64 | 1811 |
| 1248988 | N/A | N/A | 143940 | 143959 | ATTGAGTTTTTAATAAGGCT | 63 | 1812 |
| 1249014 | N/A | N/A | 146203 | 146222 | ATATTAACACTATCTAGACT | 59 | 1813 |
| 1249040 | N/A | N/A | 147348 | 147367 | TTTTAATTTTTTCTCCCCTA | 70 | 1814 |
| 1249066 | N/A | N/A | 151071 | 151090 | AGCAGTTTAAATCTCAAATA | 94 | 1815 |
| 1249092 | N/A | N/A | 155991 | 156010 | AACAGATACATAACAGGACA | 98 | 1816 |
| 1249118 | N/A | N/A | 158779 | 158798 | CAGGATTTTTAATACCACC | 61 | 1817 |
| 1249144 | N/A | N/A | 163722 | 163741 | ACAATATTTCATAAATCTCT | 84 | 1818 |
| 1249170 | N/A | N/A | 170178 | 170197 | TGTAGCTCAATAACTTGGTC | 16 | 1819 |
| 1249196 | N/A | N/A | 171702 | 171721 | GCTTGAAACATAATAATAGA | 20 | 1820 |
| 1249222 | N/A | N/A | 172560 | 172579 | GTATCTTAGACTATTAGCCT | 14 | 1821 |
| 1249248 | N/A | N/A | 173442 | 173461 | ACACTAATTTATATTTCTTA | 79 | 1822 |
| 1249274 | N/A | N/A | 175517 | 175536 | TCTTTGTTATTCTATAGGAA | 15 | 1823 |
| 1249300 | N/A | N/A | 176734 | 176753 | TAACTAGGGTCAAGTTTTTA | 47 | 1824 |
| 1249326 | N/A | N/A | 177609 | 177628 | TATTATTCCTCTAATGACAA | 59 | 1825 |
| 1249352 | N/A | N/A | 178286 | 178305 | TTTGAATTCTAAAACTGAAC | 101 | 1826 |
| 1249378 | N/A | N/A | 179455 | 179474 | TTTATTGCTATAACAAACAA | 72 | 1827 |
| 1249404 | N/A | N/A | 180196 | 180215 | TATGAAGATCAAATTTGTTA | 63 | 1828 |
| 1249430 | N/A | N/A | 180782 | 180801 | TTTATGCACTACCATGCCTT | 31 | 1829 |
| 1249456 | N/A | N/A | 183619 | 183638 | TTAGAGAACTAAACAACTTA | 79 | 1830 |
| 1249482 | N/A | N/A | 183971 | 183990 | ATCAACCAAATAGGGCCAAA | 21 | 1831 |
| 1249508 | N/A | N/A | 184935 | 184954 | GGCAAAGCTCACAAATGTTT | 54 | 1832 |
| 1249534 | N/A | N/A | 185691 | 185710 | TTGCATGATCCCAATAATAA | 36 | 1833 |
| 1249560 | N/A | N/A | 187312 | 187331 | AAAGCAATTATAATTATCCA | 54 | 1834 |

TABLE 25-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249586 | N/A | N/A | 189969 | 189988 | ATTCTTCATAGGCAACTTGA | 32 | 1835 |
| 1249612 | N/A | N/A | 191509 | 191528 | CATTCATTACATAAATGCAT | 32 | 1836 |
| 1249638 | N/A | N/A | 200162 | 200181 | TGGAGGCTAAATATAAAAAA | 66 | 1837 |
| 1249664 | N/A | N/A | 200620 | 200639 | TCAAAGTCACAAATTAACAC | 40 | 1838 |
| 1249690 | N/A | N/A | 202487 | 202506 | CATTCAATTATTCATTCCAA | 38 | 1839 |
| 1249716 | N/A | N/A | 202978 | 202997 | GTAAATTAATTTATTGCTTA | 61 | 1840 |
| 1249742 | N/A | N/A | 203617 | 203636 | AAACATACATATAATTCATA | 68 | 1841 |
| 1249768 | N/A | N/A | 205038 | 205057 | ATTTCTAAATTTAATATTGC | 71 | 1842 |
| 1249794 | N/A | N/A | 206911 | 206930 | CTCTTCATTCCTACTTCTAA | 80 | 1843 |
| 1249820 | N/A | N/A | 208583 | 208602 | TCTTAATTTTTATATATGTT | 79 | 1844 |
| 1249846 | N/A | N/A | 210278 | 210297 | ATTTTTCCTTTTAATTCTCT | 56 | 1845 |
| 1249872 | N/A | N/A | 213259 | 213278 | GGACATTTAAATAATAGATA | 70 | 1846 |
| 1249898 | N/A | N/A | 215561 | 215580 | AGTGTATTCAAATAATATTA | 41 | 1847 |
| 1249924 | N/A | N/A | 220524 | 220543 | ACATACATATACACTTGCCA | 32 | 1848 |
| 1249950 | N/A | N/A | 223280 | 223299 | ATTACATATTTAATTGTTT | 84 | 1849 |
| 1249976 | N/A | N/A | 227672 | 227691 | CCTTATTTAAACATTTTTAC | 75 | 1850 |
| 1250002 | N/A | N/A | 230675 | 230694 | GCATGGCTTCCACATTATTA | 34 | 1851 |
| 1250028 | N/A | N/A | 233370 | 233389 | TTTAGATATTATACTTCCAA | 34 | 1852 |
| 1250054 | N/A | N/A | 235344 | 235363 | CCTGTATTTTCTCTTATTTA | 30 | 1853 |
| 1250080 | N/A | N/A | 236952 | 236971 | ATAAAATATTTCCTTAGCAT | 63 | 1854 |
| 1250106 | N/A | N/A | 239989 | 240008 | TAGCACTACTATAATGGATT | 51 | 1855 |
| 1250132 | N/A | N/A | 243091 | 243110 | TTCTATTAAATTTTATGATC | 76 | 1856 |
| 1250158 | N/A | N/A | 246379 | 246398 | CAGTCTGCTCTCAATAATAA | 46 | 1857 |
| 1250184 | N/A | N/A | 247996 | 248015 | AGACTCATTTTAATTACACA | 25 | 1858 |
| 1250210 | N/A | N/A | 252125 | 252144 | ATTATCCTAAACATGTGCAT | 33 | 1859 |
| 1250236 | 4786 | 4805 | 254154 255547 | 254173 255566 | TGGTTTCTTTGAACCCAGTT | 19 | 1860 |
| 1250262 | N/A | N/A | 255517 255626 | 255536 255645 | ATCCTCCCTCTTTTCCTGTG | 47 | 1861 |
| 1250288 | N/A | N/A | 258110 | 258129 | ACATCAAACACTACTTGTTC | 57 | 1862 |
| 1250312 | N/A | N/A | 260697 | 260716 | AATCTTCTTATATTTACTTC | 71 | 1863 |

TABLE 26

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 26 | 227 |
| 1248347 | 166 | 185 | 112579 | 112598 | ATGTGTTGAATATAACAGTC | 68 | 1864 |
| 1248373 | 568 | 587 | 170039 | 170058 | GAATCGAGAGATTGCTTTCC | 30 | 1865 |
| 1248399 | 1182 | 1201 | 183529 | 183548 | TTGAAAGTAGTACCATTCCC | 26 | 1866 |
| 1248425 | 1895 | 1914 | 188704 | 188723 | GCCTACTTCCTTCCAAGGAA | 22 | 1867 |
| 1248451 | 2496 | 2515 | 204398 | 204417 | AACCATGGTTTACAACAGTC | 39 | 1868 |
| 1248477 | 3307 | 3326 | 227301 | 227320 | AAAATCGATTCCTTTCTGCA | 31 | 1869 |
| 1248503† | 3860 | 3879 | 240278 | 240297 | ATGTTTTCCTCAAATTCCAC | 40 | 1870 |
| 1248529 | 4391 | 4410 | 247825 | 247844 | TTACATCAAACATCTCTCCA | 49 | 1871 |
| 1248554 | 6042 | 6061 | 262570 | 262589 | ACCTTTTTAACTTTTGCTT | 45 | 1872 |
| 1248580 | 6478 | 6497 | 263006 | 263025 | TCGATACTATTTCTCCAGTT | 33 | 1873 |
| 1248606 | 7193 | 7212 | 263721 | 263740 | AGGACACTTATCAAAAATGT | 37 | 1874 |
| 1248631 | 7372 | 7391 | 263900 | 263919 | AAGCAGACTTTTATTTTTA | 43 | 1875 |
| 1248657 | 7507 | 7526 | 264035 | 264054 | AATTACATCATATTACCTGT | 37 | 1876 |
| 1248682 | 7636 | 7655 | 264164 | 264183 | CAATTTGCTTCACTTTACCA | 63 | 1877 |
| 1248707 | 7953 | 7972 | 264481 | 264500 | GCTTCAATTTAAAAGTGCTA | 43 | 1878 |
| 1248732 | 8279 | 8298 | 264807 | 264826 | GCTGGGATCCCATATTATAT | 51 | 1879 |
| 1248758 | 8419 | 8438 | 264947 | 264966 | GCATGCATTTCACCAACACA | 53 | 1880 |
| 1248784 | 8588 | 8607 | 265116 | 265135 | ATTTGTTTTTCAGATAGATT | 71 | 1881 |
| 1248809 | 8677 | 8696 | 265205 | 265224 | AGTAGTTATCCAATACACTC | 56 | 1882 |
| 1248834 | N/A | N/A | 113801 | 113820 | ATTTTATAAAATCATTCCCC | 79 | 1883 |
| 1248860 | N/A | N/A | 117455 | 117474 | GTCTTCTTCCACATAAAGGT | 63 | 1884 |
| 1248886 | N/A | N/A | 123365 | 123384 | GTCTACTCAAACAAACACTA | 60 | 1885 |
| 1248912 | N/A | N/A | 126286 | 126305 | AAGAATTTCATAAACTTCAT | 87 | 1886 |
| 1248937 | N/A | N/A | 128501 128544 | 128520 128563 | ATGGAGTTAAACCATAGAGC | 64 | 1887 |
| 1248963 | N/A | N/A | 139924 | 139943 | GTTTATTCCTCAATATTTTT | 75 | 1888 |
| 1248989 | N/A | N/A | 144023 | 144042 | GCACAGTATTTTACTTATCA | 74 | 1889 |
| 1249015 | N/A | N/A | 146216 | 146235 | ATAATTTCTATCAATATTAA | 78 | 1890 |
| 1249041 | N/A | N/A | 147450 | 147469 | CAGTCATTCCTAATACATTA | 56 | 1891 |
| 1249067 | N/A | N/A | 152305 | 152324 | GTCTTCCCTATCTCAACCAA | 75 | 1892 |
| 1249093 | N/A | N/A | 156022 | 156041 | TGCATCTTCATTACCATCAA | 68 | 1893 |
| 1249119 | N/A | N/A | 161701 | 161720 | CTTCTCTTTTTAACCTGAAT | 78 | 1894 |
| 1249145 | N/A | N/A | 163896 | 163915 | GTCACATTCTCATCATATTT | 64 | 1895 |
| 1249171 | N/A | N/A | 170180 | 170199 | TGTGTAGCTCAATAACTTGG | 24 | 1896 |
| 1249197 | N/A | N/A | 171772 | 171791 | GAACATACAATTATTTTAAA | 81 | 1897 |
| 1249223 | N/A | N/A | 172625 | 172644 | ACCTCTAACTTTACTGGGCT | 24 | 1898 |

TABLE 26-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249249 | N/A | N/A | 173459 | 173478 | TGTCACTCCTCCCTTTGACA | 36 | 1899 |
| 1249275 | N/A | N/A | 175540 | 175559 | AGAGTATAAAATTATAGGAC | 38 | 1900 |
| 1249301 | N/A | N/A | 176818 | 176837 | ATCATTTTAATAAAAGTATA | 91 | 1901 |
| 1249327 | N/A | N/A | 177610 | 177629 | ATATTATTCCTCTAATGACA | 57 | 1902 |
| 1249353 | N/A | N/A | 178288 | 178307 | ATTTTGAATTCTAAAACTGA | 94 | 1903 |
| 1249379 | N/A | N/A | 179465 | 179484 | ACAATTTTCTTTATTGCTA | 41 | 1904 |
| 1249405 | N/A | N/A | 180277 | 180296 | GCAAAATTACTTATTAAGTT | 66 | 1905 |
| 1249431 | N/A | N/A | 180926 | 180945 | ATACTTACTCCACATTCTTT | 71 | 1906 |
| 1249457 | N/A | N/A | 183621 | 183640 | ATTTAGAGAACTAAACAACT | 57 | 1907 |
| 1249483 | N/A | N/A | 183972 | 183991 | CATCAACCAAATAGGGCCAA | 17 | 1908 |
| 1249509 | N/A | N/A | 185086 | 185105 | TAGGAAGCATCACTTACCCT | 109 | 1909 |
| 1249535 | N/A | N/A | 185714 | 185733 | CCATGTTTCTTAATAGCAAA | 41 | 1910 |
| 1249561 | N/A | N/A | 187364 | 187383 | TTGTTAATCATTAATTTCCT | 42 | 1911 |
| 1249587 | N/A | N/A | 189970 | 189989 | CATTCTTCATAGGCAACTTG | 36 | 1912 |
| 1249613 | N/A | N/A | 191698 | 191717 | AGTTTATATTTTAACTGCCA | 25 | 1913 |
| 1249639 | N/A | N/A | 200199 | 200218 | GGTGTTCAAAATATACCTTA | 19 | 1914 |
| 1249665 | N/A | N/A | 200622 | 200641 | ATTCAAAGTCACAAATTAAC | 65 | 1915 |
| 1249691 | N/A | N/A | 202499 | 202518 | CTAAAATAAAATCATTCAAT | 77 | 1916 |
| 1249717 | N/A | N/A | 202983 | 203002 | CCTAAGTAAATTAATTTATT | 78 | 1917 |
| 1249743 | N/A | N/A | 203657 | 203676 | AACTCATTTATTACTGGAAA | 36 | 1918 |
| 1249769 | N/A | N/A | 205059 | 205078 | TTTAACAAAATTAAATAAAT | 106 | 1919 |
| 1249795 | N/A | N/A | 206914 | 206933 | CCTCTCTTCATTCCTACTTC | 49 | 1920 |
| 1249821 | N/A | N/A | 208591 | 208610 | ATGACCTATCTTAATTTTTA | 67 | 1921 |
| 1249847 | N/A | N/A | 210310 | 210329 | ATATTATCCCATATTATAGT | 58 | 1922 |
| 1249873 | N/A | N/A | 213321 | 213340 | CATGTGTATATTACTAGACT | 34 | 1923 |
| 1249899 | N/A | N/A | 215633 | 215652 | AGTGAACTTTATTAAAGCTA | 35 | 1924 |
| 1249925 | N/A | N/A | 220797 | 220816 | GATCAACCTTCCTATTGTAA | 91 | 1925 |
| 1249951 | N/A | N/A | 224068 | 224087 | CATCTATAAAATAAATGTAA | 104 | 1926 |
| 1249977 | N/A | N/A | 227766 | 227785 | CAGATATTTTCTATTTTCTT | 48 | 1927 |
| 1250003 | N/A | N/A | 230954 | 230973 | TGTTTTTATTTTACTGCCAA | 42 | 1928 |
| 1250029 | N/A | N/A | 233409 | 233428 | ATCTAATAAACATCAAGGTA | 41 | 1929 |
| 1250055 | N/A | N/A | 235366 | 235385 | ATTTCAAATTATAAAAGACA | 81 | 1930 |
| 1250081 | N/A | N/A | 237009 | 237028 | ATGTGGATTTTCTCTAGAAA | 23 | 1931 |
| 1250107 | N/A | N/A | 239994 | 240013 | GTTTATAGCACTACTATAAT | 52 | 1932 |
| 1250133 | N/A | N/A | 243092 | 243111 | ATTCTATTAAATTTTATGAT | 73 | 1933 |
| 1250159 | N/A | N/A | 246419 | 246438 | AAATTCTCCATAAATTTGAC | 88 | 1934 |

TABLE 26-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250185 | N/A | N/A | 248151 | 248170 | CTGTTTTCCATAAAAGCTAT | 37 | 1935 |
| 1250211 | N/A | N/A | 252236 | 252255 | TTCATTTTCATCACTATATA | 53 | 1936 |
| 1250237 | 4787 | 4806 | 254155 | 254174 | GTGGTTTCTTTGAACCCAGT | 31 | 1937 |
|  |  |  | 255548 | 255567 |  |  |  |
| 1250263 | N/A | N/A | 255611 | 255630 | CTGTGTTTCATAACAGGCAA | 42 | 1938 |
| 1250289 | N/A | N/A | 258117 | 258136 | TTTTTGGACATCAAACACTA | 92 | 1939 |
| 1250313 | N/A | N/A | 260701 | 260720 | CTTAAATCTTCTTATATTTA | 95 | 1940 |

TABLE 27

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 24 | 227 |
| 1248348 | 193 | 212 | 112606 | 112625 | ATGTAAATCATAACACAGAA | 90 | 1941 |
| 1248374 | 569 | 588 | 170040 | 170059 | TGAATCGAGAGATTGCTTTC | 35 | 1942 |
| 1248400 | 1196 | 1215 | 183543 | 183562 | TGCTCACTGTCCTATTGAAA | 27 | 1943 |
| 1248426 | 1922 | 1941 | 188731 | 188750 | GAGAAGAAAATCTCTTTTCA | 55 | 1944 |
| 1248452 | 2504 | 2523 | 204406 | 204425 | TCACCTTTAACCATGGTTTA | 67 | 1945 |
| 1248478 | 3323 | 3342 | 227317 | 227336 | GTATTTTCTTTTAACAAAA | 49 | 1946 |
| 1248504† | 3863 | 3882 | 240281 | 240300 | AGCATGTTTTCCTCAAATTC | 38 | 1947 |
| 1248530 | 4392 | 4411 | 247826 | 247845 | CTTACATCAAACATCTCTCC | 41 | 1948 |
| 1248555 | 6046 | 6065 | 262574 | 262593 | TGATACCTTTTAACTTTTT | 61 | 1949 |
| 1248581 | 6592 | 6611 | 263120 | 263139 | TTACATAAAAATTTAACTTC | 87 | 1950 |
| 1248607 | 7195 | 7214 | 263723 | 263742 | AAAGGACACTTATCAAAAAT | 69 | 1951 |
| 1248632 | 7384 | 7403 | 263912 | 263931 | TTACTATTTACAAAGCAGAC | 67 | 1952 |
| 1248658 | 7508 | 7527 | 264036 | 264055 | CAATTACATCATATTACCTG | 58 | 1953 |
| 1248683 | 7637 | 7656 | 264165 | 264184 | ACAATTGCTTCACTTTACC | 52 | 1954 |
| 1248708 | 7954 | 7973 | 264482 | 264501 | TGCTTCAATTTAAAAGTGCT | 44 | 1955 |
| 1248733 | 8280 | 8299 | 264808 | 264827 | AGCTGGGATCCCATATTATA | 53 | 1956 |
| 1248759 | 8420 | 8439 | 264948 | 264967 | TGCATGCATTTCACCAACAC | 45 | 1957 |
| 1248785 | 8600 | 8619 | 265128 | 265147 | TGTGTTCTTTACATTTGTTT | 58 | 1958 |
| 1248810 | 8678 | 8697 | 265206 | 265225 | AAGTAGTTATCCAATACACT | 60 | 1959 |
| 1248835 | N/A | N/A | 113871 | 113890 | ATGTAGAACTACAAACTCTA | 61 | 1960 |
| 1248861 | N/A | N/A | 117498 | 117517 | ATAAGATTTTTCATTATTA | 76 | 1961 |
| 1248887 | N/A | N/A | 123399 | 123418 | ACTATATCCATATCATTTTA | 77 | 1962 |

TABLE 27-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248913 | N/A | N/A | 126445 | 126464 | CTTTATCTCTCCAAACCATC | 84 | 1963 |
| 1248938 | N/A | N/A | 128503 128546 | 128522 128565 | ATATGGAGTTAAACCATAGA | 67 | 1964 |
| 1248964 | N/A | N/A | 139945 | 139964 | ACAGATATTTCACCTCATTA | 75 | 1965 |
| 1248990 | N/A | N/A | 144248 | 144267 | TCTTTGCTCATAATACCATT | 72 | 1966 |
| 1249016 | N/A | N/A | 146217 | 146236 | TATAATTTCTATCAATATTA | 75 | 1967 |
| 1249042 | N/A | N/A | 147470 | 147489 | CTAGCATATTCCATTACTTC | 71 | 1968 |
| 1249068 | N/A | N/A | 152306 | 152325 | TGTCTTCCCTATCTCAACCA | 72 | 1969 |
| 1249094 | N/A | N/A | 156025 | 156044 | CACTGCATCTTCATTACCAT | 65 | 1970 |
| 1249120 | N/A | N/A | 161702 | 161721 | CCTTCTCTTTTTAACCTGAA | 80 | 1971 |
| 1249146 | N/A | N/A | 165017 | 165036 | CCGTAGCTTCCCTACAGCTA | 75 | 1972 |
| 1249172 | N/A | N/A | 170181 | 170200 | ATGTGTAGCTCAATAACTTG | 31 | 1973 |
| 1249198 | N/A | N/A | 171775 | 171794 | AAGGAACATACAATTATTTT | 56 | 1974 |
| 1249224 | N/A | N/A | 172632 | 172651 | TCTATATACCTCTAACTTTA | 68 | 1975 |
| 1249250 | N/A | N/A | 173610 | 173629 | CTTCAGACTTTACCTTCATA | 52 | 1976 |
| 1249276 | N/A | N/A | 175562 | 175581 | TTACCATTAATAACTCATTT | 41 | 1977 |
| 1249302 | N/A | N/A | 176821 | 176840 | GCTATCATTTTAATAAAAGT | 41 | 1978 |
| 1249328 | N/A | N/A | 177620 | 177639 | AGCAGCCCTTATATTATTCC | 15 | 1979 |
| 1249354 | N/A | N/A | 178311 | 178330 | TACATATCTTATCAACACTT | 55 | 1980 |
| 1249380 | N/A | N/A | 179595 | 179614 | ATGAAAACACTCATAAGTAA | 68 | 1981 |
| 1249406 | N/A | N/A | 180349 | 180368 | GCTCATAAAATCCTGAACTA | 23 | 1982 |
| 1249432 | N/A | N/A | 180932 | 180951 | ATATTTATACTTACTCCACA | 100 | 1983 |
| 1249458 | N/A | N/A | 183643 | 183662 | TCCATTATATATAATATTTA | 92 | 1984 |
| 1249484 | N/A | N/A | 183974 | 183993 | TGCATCAACCAAATAGGGCC | 15 | 1985 |
| 1249510 | N/A | N/A | 185226 | 185245 | ATCTACACTTATCCTGGCTA | 96 | 1986 |
| 1249536 | N/A | N/A | 185715 | 185734 | TCCATGTTTCTTAATAGCAA | 26 | 1987 |
| 1249562 | N/A | N/A | 187367 | 187386 | CCTTTGTTAATCATTAATTT | 53 | 1988 |
| 1249588 | N/A | N/A | 189971 | 189990 | GCATTCTTCATAGGCAACTT | 16 | 1989 |
| 1249614 | N/A | N/A | 191779 | 191798 | ATACTGCTCCTCATTAGCTA | 65 | 1990 |
| 1249640 | N/A | N/A | 200200 | 200219 | TGGTGTTCAAAATATACCTT | 48 | 1991 |
| 1249666 | N/A | N/A | 200631 | 200650 | GAGACTGAAATTCAAAGTCA | 45 | 1992 |
| 1249692 | N/A | N/A | 202500 | 202519 | TCTAAAATAAAATCATTCAA | 89 | 1993 |
| 1249718 | N/A | N/A | 203006 | 203025 | AATTAATTCTATAATACTAT | 79 | 1994 |
| 1249744 | N/A | N/A | 203683 | 203702 | TTACAAATCAACATTTCACA | 60 | 1995 |
| 1249770 | N/A | N/A | 205107 | 205126 | ATACTATATTATAATATCAA | 80 | 1996 |
| 1249796 | N/A | N/A | 206945 | 206964 | CTTTTTCTTTCTAAAAGATC | 73 | 1997 |

TABLE 27-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249822 | N/A | N/A | 208673 | 208692 | TCATTGCTTAATAATAGGTC | 25 | 1998 |
| 1249848 | N/A | N/A | 210312 | 210331 | TGATATTATCCCATATTATA | 47 | 1999 |
| 1249874 | N/A | N/A | 213367 | 213386 | GTGACTTTTCCAAATATTAC | 46 | 2000 |
| 1249900 | N/A | N/A | 215699 | 215718 | CTGTTTCCTCCTCTCTATTA | 71 | 2001 |
| 1249926 | N/A | N/A | 220846 | 220865 | TCTCAGTTAAATATATTTTA | 69 | 2002 |
| 1249952 | N/A | N/A | 224116 | 224135 | TTTCTGTTACCTACTAAGTA | 49 | 2003 |
| 1249978 | N/A | N/A | 228224 | 228243 | TGATTCCTCATCAATACCTT | 45 | 2004 |
| 1250004 | N/A | N/A | 230955 | 230974 | ATGTTTTTATTTTACTGCCA | 36 | 2005 |
| 1250030 | N/A | N/A | 233413 | 233432 | AATGATCTAATAAACATCAA | 83 | 2006 |
| 1250056 | N/A | N/A | 235406 | 235425 | GGTGTTTTTTTTAATTGCTT | 32 | 2007 |
| 1250082 | N/A | N/A | 237351 | 237370 | AATGCAATAAACTTTAGCCA | 54 | 2008 |
| 1250108 | N/A | N/A | 240033 | 240052 | GGCTTTTTAATCATTTGTTT | 30 | 2009 |
| 1250134 | N/A | N/A | 243096 | 243115 | AAAAATTCTATTAAATTTTA | 89 | 2010 |
| 1250160 | N/A | N/A | 246422 | 246441 | CACAAATTCTCCATAAATTT | 55 | 2011 |
| 1250186 | N/A | N/A | 248152 | 248171 | ACTGTTTTCCATAAAAGCTA | 39 | 2012 |
| 1250212 | N/A | N/A | 252444 | 252463 | CTGGAGGTAATCATTATCCT | 33 | 2013 |
| 1250238 | 4788 | 4807 | 254156 255549 | 254175 255568 | TGTGGTTTCTTTGAACCCAG | 16 | 2014 |
| 1250264 | N/A | N/A | 255673 | 255692 | CACAAAATATCAACTAGCTT | 61 | 2015 |
| 1250290 | N/A | N/A | 258143 | 258162 | GAGGCTTCTATTACTTCCAA | 48 | 2016 |
| 1250314 | N/A | N/A | 260862 | 260881 | ATCTTACCTCTTAATGCTAC | 71 | 2017 |

TABLE 28

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910092 | 8731 | 8750 | 265259 | 265278 | GTAACTTTCCACTAGTCTAC | 58 | 432 |
| 910263 | N/A | N/A | 180777 | 180796 | GCACTACCATGCCTTCACCA | 27 | 227 |
| 1248349 | 197 | 216 | 112610 | 112629 | AAAAATGTAAATCATAACAC | 80 | 2018 |
| 1248375 | 571 | 590 | 170042 | 170061 | ACTGAATCGAGAGATTGCTT | 27 | 2019 |
| 1248401 | 1219 | 1238 | 183566 | 183585 | AATATATTCATCCCAGTTAA | 57 | 2020 |
| 1248427 | 2308 | 2327 | 199865 | 199884 | TCTCTTTCTTATTTCTGTTT | 47 | 2021 |
| 1248453 | 2505 | 2524 | 204407 | 204426 | TTCACCTTTAACCATGGTTT | 70 | 2022 |
| 1248479 | 3363 | 3382 | 227357 | 227376 | GCTTTCTGCTTCCTAACAAA | 23 | 2023 |

TABLE 28-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248505† | 3864 | 3883 | 240282 | 240301 | TAGCATGTTTTCCTCAAATT | 29 | 2024 |
| 1248531 | 4398 | 4417 | 247832 | 247851 | ACCACGCTTACATCAAACAT | 44 | 2025 |
| 1248556 | 6047 | 6066 | 262575 | 262594 | TTGATACCTTTTTAACTTTT | 54 | 2026 |
| 1248582 | 6593 | 6612 | 263121 | 263140 | TTTACATAAAAATTTAACTT | 88 | 2027 |
| 1248608 | 7198 | 7217 | 263726 | 263745 | GCCAAAGGACACTTATCAAA | 35 | 2028 |
| 1248633 | 7385 | 7404 | 263913 | 263932 | ATTACTATTTACAAAGCAGA | 66 | 2029 |
| 1248659 | 7509 | 7528 | 264037 | 264056 | CCAATTACATCATATTACCT | 47 | 2030 |
| 1248684 | 7703 | 7722 | 264231 | 264250 | CAAGAAGCTCTTCCTTGTTT | 62 | 2031 |
| 1248709 | 7955 | 7974 | 264483 | 264502 | GTGCTTCAATTTAAAAGTGC | 43 | 2032 |
| 1248734 | 8317 | 8336 | 264845 | 264864 | ATAACTTCACTACCTGGTTT | 50 | 2033 |
| 1248760 | 8421 | 8440 | 264949 | 264968 | CTGCATGCATTTCACCAACA | 40 | 2034 |
| 1248786 | 8601 | 8620 | 265129 | 265148 | GTGTGTTCTTTACATTTGTT | 66 | 2035 |
| 1248836 | N/A | N/A | 113905 | 113924 | CTGTAATTCTAAAAATCTCC | 76 | 2036 |
| 1248862 | N/A | N/A | 117593 | 117612 | TATCACATTCCAATAAATAA | 74 | 2037 |
| 1248888 | N/A | N/A | 123415 | 123434 | TTAAAATTTTCTATATACTA | 77 | 2038 |
| 1248914 | N/A | N/A | 126502 | 126521 | TTTATGGACATTAAACTTCA | 76 | 2039 |
| 1248939 | N/A | N/A | 128505 128548 | 128524 128567 | GGATATGGAGTTAAACCATA | 74 | 2040 |
| 1248965 | N/A | N/A | 140046 | 140065 | TTTAAGAACATTAATTCTTT | 83 | 2041 |
| 1248991 | N/A | N/A | 144249 | 144268 | GTCTTTGCTCATAATACCAT | 67 | 2042 |
| 1249017 | N/A | N/A | 146222 | 146241 | TTAGTTATAATTTCTATCAA | 86 | 2043 |
| 1249043 | N/A | N/A | 147483 | 147502 | GTAGCTATATTCACTAGCAT | 59 | 2044 |
| 1249069 | N/A | N/A | 152331 | 152350 | TCAGTTTCTTCCATTTGAAA | 82 | 2045 |
| 1249095 | N/A | N/A | 156157 | 156176 | TCTTCTTTTTTCCTAAGTTA | 65 | 2046 |
| 1249121 | N/A | N/A | 161709 | 161728 | TATGTATCCTTCTCTTTTTA | 92 | 2047 |
| 1249147 | N/A | N/A | 165658 | 165677 | TAGAACAGTTCTAATTGTTA | 95 | 2048 |
| 1249173 | N/A | N/A | 170182 | 170201 | AATGTGTAGCTCAATAACTT | 47 | 2049 |
| 1249199 | N/A | N/A | 171856 | 171875 | TTCCCAATGTCTACTAGGAA | 31 | 2050 |
| 1249225 | N/A | N/A | 172637 | 172656 | CAGCATCTATATACCTCTAA | 23 | 2051 |
| 1249251 | N/A | N/A | 174327 | 174346 | GTCATGACTTTAAATACCAG | 19 | 2052 |
| 1249277 | N/A | N/A | 175566 | 175585 | TTTCTTACCATTAATAACTC | 40 | 2053 |
| 1249303 | N/A | N/A | 176825 | 176844 | CATGGCTATCATTTTAATAA | 29 | 2054 |
| 1249329 | N/A | N/A | 177648 | 177667 | GATTGACCTATTACCAGTTA | 45 | 2055 |
| 1249355 | N/A | N/A | 178312 | 178331 | TTACATATCTTATCAACACT | 46 | 2056 |
| 1249381 | N/A | N/A | 179609 | 179628 | GTTTTTTCATCCATATGAAA | 47 | 2057 |
| 1249407 | N/A | N/A | 180430 | 180449 | TAACATCATTCTAAAAGTTA | 69 | 2058 |

TABLE 28-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249433 | N/A | N/A | 180935 | 180954 | AAAATATTTATACTTACTCC | 77 | 2059 |
| 1249459 | N/A | N/A | 183649 | 183668 | ATAATTTCCATTATATATAA | 96 | 2060 |
| 1249485 | N/A | N/A | 183975 | 183994 | TTGCATCAACCAAATAGGGC | 14 | 2061 |
| 1249511 | N/A | N/A | 185231 | 185250 | TGAGAATCTACACTTATCCT | 59 | 2062 |
| 1249537 | N/A | N/A | 185740 | 185759 | TTTTTAAATTTTCCTAGGAT | 80 | 2063 |
| 1249563 | N/A | N/A | 187450 | 187469 | TAACTGAATTCCTCTTCCCC | 66 | 2064 |
| 1249589 | N/A | N/A | 189973 | 189992 | AGGCATTCTTCATAGGCAAC | 24 | 2065 |
| 1249615 | N/A | N/A | 191856 | 191875 | TCCTTTCTCTCCTCTAACAA | 65 | 2066 |
| 1249641 | N/A | N/A | 200201 | 200220 | GTGGTGTTCAAAATATACCT | 52 | 2067 |
| 1249667 | N/A | N/A | 200664 | 200683 | CCTAAACATCATCATCCACA | 47 | 2068 |
| 1249693 | N/A | N/A | 202504 | 202523 | AAGTTCTAAAATAAAATCAT | 81 | 2069 |
| 1249719 | N/A | N/A | 203014 | 203033 | TTGCCACTAATTAATTCTAT | 49 | 2070 |
| 1249745 | N/A | N/A | 203760 | 203779 | CTACATTTCTCATTTAACTA | 57 | 2071 |
| 1249771 | N/A | N/A | 205133 | 205152 | ACCACTTTAAAATCTATCAC | 48 | 2072 |
| 1249797 | N/A | N/A | 207008 | 207027 | TTTCAATTTCACATAGGTTA | 51 | 2073 |
| 1249823 | N/A | N/A | 208725 | 208744 | CCTTTTTTTCTTATTGCTA | 42 | 2074 |
| 1249849 | N/A | N/A | 210335 | 210354 | ATTATATAAATATTTAGACT | 80 | 2075 |
| 1249875 | N/A | N/A | 213368 | 213387 | AGTGACTTTTCCAAATATTA | 42 | 2076 |
| 1249901 | N/A | N/A | 215842 | 215861 | ATTCCATAATTCTTTAGTTC | 43 | 2077 |
| 1249927 | N/A | N/A | 220875 | 220894 | TCTTTCTTCCTACCAAGCTA | 59 | 2078 |
| 1249953 | N/A | N/A | 224198 | 224217 | CAGCATGTTTATCTTAGTTC | 17 | 2079 |
| 1249979 | N/A | N/A | 228226 | 228245 | TGTGATTCCTCATCAATACC | 40 | 2080 |
| 1250005 | N/A | N/A | 231098 | 231117 | GCATGCACTTTTACTTTTCA | 25 | 2081 |
| 1250031 | N/A | N/A | 233414 | 233433 | TAATGATCTAATAAACATCA | 68 | 2082 |
| 1250057 | N/A | N/A | 235526 | 235545 | CTGTCTGTTTTCAATAGCCT | 36 | 2083 |
| 1250083 | N/A | N/A | 237406 | 237425 | GTTAAATCAAATATCACCAA | 42 | 2084 |
| 1250109 | N/A | N/A | 240123 | 240142 | ATTTACATTATTACCTGATA | 70 | 2085 |
| 1250135 | N/A | N/A | 243099 | 243118 | TCAAAAAATTCTATTAAATT | 85 | 2086 |
| 1250161 | N/A | N/A | 246430 | 246449 | GTGTAAGACACAAATTCTCC | 23 | 2087 |
| 1250187 | N/A | N/A | 249170 | 249189 | CATATCTACTCACTTAGCTA | 50 | 2088 |
| 1250213 | N/A | N/A | 252473 | 252492 | CTTCTCAAACATAAACTCCA | 61 | 2089 |
| 1250239 | 4789 | 4808 | 254157 255550 | 254176 255569 | TTGTGGTTTCTTTGAACCCA | 26 | 2090 |
| 1250265 | N/A | N/A | 255680 | 255699 | ACAGTTTCACAAAATATCAA | 58 | 2091 |

TABLE 28-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250291 | N/A | N/A | 258473 | 258492 | GAAATATTCAATCTTTGCCC | 65 | 2092 |
| 1250315 | N/A | N/A | 260869 | 260888 | ATCTCAAATCTTACCTCTTA | 81 | 2093 |

TABLE 29

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 17 | 227 |
| 1248350 | 250 | 269 | 168795 | 168814 | CTGCTCCTTTAATCACTGTT | 20 | 2094 |
| 1248376 | 624 | 643 | 170095 | 170114 | GCTAATTTTCTAATAGGGTT | 13 | 2095 |
| 1248402 | 1221 | 1240 | 183568 | 183587 | TCAATATATTCATCCCAGTT | 41 | 2096 |
| 1248428 | 2309 | 2328 | 199866 | 199885 | GTCTCTTTCTTATTTCTGTT | 32 | 2097 |
| 1248454 | 2507 | 2526 | 204409 | 204428 | GTTTCACCTTTAACCATGGT | 41 | 2098 |
| 1248480 | 3425 | 3444 | 227419 | 227438 | GGTTGGAAATACAGCTGTCT | 15 | 2099 |
| 1248506† | 3896 | 3915 | 240314 | 240333 | AGGTTTCGAACCAATTGTGC | 24 | 2100 |
| 1248532 | 4461 | 4480 | 247895 | 247914 | ACATTTTTCCACCTGGCAGT | 24 | 2101 |
| 1248557 | 6049 | 6068 | 262577 | 262596 | ACTTGATACCTTTTTAACTT | 55 | 2102 |
| 1248583 | 6601 | 6620 | 263129 | 263148 | ATGTTGAATTTACATAAAAA | 77 | 2103 |
| 1248609 | 7212 | 7231 | 263740 | 263759 | TATTTTTATTTTATGCCAAA | 79 | 2104 |
| 1248634 | 7390 | 7409 | 263918 | 263937 | GTAAAATTACTATTTACAAA | 87 | 2105 |
| 1248660 | 7510 | 7529 | 264038 | 264057 | ACCAATTACATCATATTACC | 37 | 2106 |
| 1248685 | 7749 | 7768 | 264277 | 264296 | GGCTTTTCATCATTGAGTGT | 33 | 2107 |
| 1248710 | 7984 | 8003 | 264512 | 264531 | ATCCTAGTCCTTGCTTCTTA | 46 | 2108 |
| 1248735 | 8318 | 8337 | 264846 | 264865 | TATAACTTCACTACCTGGTT | 50 | 2109 |
| 1248761 | 8432 | 8451 | 264960 | 264979 | ACAGCATTTTCCTGCATGCA | 41 | 2110 |
| 1248787 | 8602 | 8621 | 265130 | 265149 | TGTGTGTTCTTTACATTTGT | 65 | 2111 |
| 1248811 | 8733 | 8752 | 265261 | 265280 | TTGTAACTTTCCACTAGTCT | 57 | 2112 |
| 1248837 | N/A | N/A | 113946 | 113965 | TGCTTTTCTTTAAATGATAA | 73 | 2113 |
| 1248863 | N/A | N/A | 117594 | 117613 | TTATCACATTCCAATAAATA | 85 | 2114 |
| 1248889 | N/A | N/A | 123738 | 123757 | CTACATTTTATCCTTTCCTA | 74 | 2115 |
| 1248915 | N/A | N/A | 126713 | 126732 | TCAAACATCTATACTTGATC | 72 | 2116 |
| 1248940 | N/A | N/A | 128508 128551 | 128527 128570 | TTAGGATATGGAGTTAAACC | 89 | 2117 |
| 1248966 | N/A | N/A | 140537 | 140556 | CCTATATTTTCTTCTAGTAC | 71 | 2118 |

TABLE 29-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
| --- | --- | --- | --- | --- | --- | --- | --- |
| 1248992 | N/A | N/A | 144250 | 144269 | GGTCTTTGCTCATAATACCA | 61 | 2119 |
| 1249018 | N/A | N/A | 146235 | 146254 | TCTAACTTATTCCTTAGTTA | 87 | 2120 |
| 1249044 | N/A | N/A | 147614 | 147633 | GTACAATTTTAAACTAGGC | 70 | 2121 |
| 1249070 | N/A | N/A | 152431 | 152450 | GCTTTCATTTCCATCCTTTA | 71 | 2122 |
| 1249096 | N/A | N/A | 156175 | 156194 | TTCCATTTCCTTCCTTTTC | 71 | 2123 |
| 1249122 | N/A | N/A | 161817 | 161836 | CAAGTCTATTTTCTTATCAA | 75 | 2124 |
| 1249148 | N/A | N/A | 165672 | 165691 | GTATCAATTATAATTAGAAC | 114 | 2125 |
| 1249174 | N/A | N/A | 170184 | 170203 | AAAATGTGTAGCTCAATAAC | 54 | 2126 |
| 1249200 | N/A | N/A | 171870 | 171889 | ATTTAATGAATATTTTCCCA | 45 | 2127 |
| 1249226 | N/A | N/A | 172638 | 172657 | ACAGCATCTATATACCTCTA | 27 | 2128 |
| 1249252 | N/A | N/A | 174390 | 174409 | TAGTTCAGCATTACTAGTGT | 19 | 2129 |
| 1249278 | N/A | N/A | 175569 | 175588 | TGGTTTCTTACCATTAATAA | 16 | 2130 |
| 1249304 | N/A | N/A | 176837 | 176856 | TTTTCCTTATTTCATGGCTA | 22 | 2131 |
| 1249330 | N/A | N/A | 177671 | 177690 | CCTCTCTTTTTCTTTAGTAC | 22 | 2132 |
| 1249356 | N/A | N/A | 178316 | 178335 | GTACTTACATATCTTATCAA | 30 | 2133 |
| 1249382 | N/A | N/A | 179685 | 179704 | TTTAGTCAAAACAATAATAA | 94 | 2134 |
| 1249408 | N/A | N/A | 180436 | 180455 | GTATTATAACATCATTCTAA | 25 | 2135 |
| 1249434 | N/A | N/A | 181116 | 181135 | TGCAGTAATTTACACAACTA | 43 | 2136 |
| 1249460 | N/A | N/A | 183650 | 183669 | GATAATTTCCATTATATATA | 74 | 2137 |
| 1249486 | N/A | N/A | 183976 | 183995 | GTTGCATCAACCAAATAGGG | 19 | 2138 |
| 1249512 | N/A | N/A | 185318 | 185337 | TTCTCTATTTTACATTGAAC | 46 | 2139 |
| 1249538 | N/A | N/A | 185746 | 185765 | ACTGTGTTTTTAAATTTTCC | 35 | 2140 |
| 1249564 | N/A | N/A | 187569 | 187588 | AGAGAACAAATATTGAATAA | 91 | 2141 |
| 1249590 | N/A | N/A | 189974 | 189993 | AAGGCATTCTTCATAGGCAA | 26 | 2142 |
| 1249616 | N/A | N/A | 191904 | 191923 | TAGTTATTTTTAAAGCCTT | 52 | 2143 |
| 1249642 | N/A | N/A | 200270 | 200289 | GCATTTATCATTACACTCTT | 24 | 2144 |
| 1249668 | N/A | N/A | 200669 | 200688 | TTATGCCTAAACATCATCAT | 76 | 2145 |
| 1249694 | N/A | N/A | 202506 | 202525 | TTAAGTTCTAAAATAAAATC | 78 | 2146 |
| 1249720 | N/A | N/A | 203028 | 203047 | CTACTAATCAACATTTGCCA | 40 | 2147 |
| 1249746 | N/A | N/A | 203763 | 203782 | TCTCTACATTTCTCATTTAA | 53 | 2148 |
| 1249772 | N/A | N/A | 205201 | 205220 | TAAGCATTTTATACTTGTAT | 23 | 2149 |
| 1249798 | N/A | N/A | 207009 | 207028 | TTTTCAATTTCACATAGGTT | 37 | 2150 |
| 1249824 | N/A | N/A | 208813 | 208832 | ATGTCTTCTTCCATTCTTTA | 29 | 2151 |
| 1249850 | N/A | N/A | 210346 | 210365 | CTGATTCTCCCATTATATAA | 51 | 2152 |
| 1249876 | N/A | N/A | 213417 | 213436 | ATGGAATCTCTCTCTACCTA | 50 | 2153 |
| 1249902 | N/A | N/A | 215847 | 215866 | GAACAATTCCATAATTCTTT | 35 | 2154 |

TABLE 29-continued

Reduction of SCN2A RNA by 5-10-5 MOE gapmers with mixed PO/PS
internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249928 | N/A | N/A | 220972 | 220991 | ACTTCATATTTAAAGCATAA | 49 | 2155 |
| 1249954 | N/A | N/A | 224537 | 224556 | GTCTTTTCTCCTAATTGTGA | 38 | 2156 |
| 1249980 | N/A | N/A | 228309 | 228328 | ATTTTACATTCTATAATGTA | 101 | 2157 |
| 1250006 | N/A | N/A | 231374 | 231393 | CCTATTCATTTACATTATTA | 47 | 2158 |
| 1250032 | N/A | N/A | 233663 | 233682 | GCCTAGTTAAAATTTAACAA | 68 | 2159 |
| 1250058 | N/A | N/A | 235611 | 235630 | ATATAGTTCAATACAAGGAA | 80 | 2160 |
| 1250084 | N/A | N/A | 237423 | 237442 | CTTTTGTTTTCCTTTAGGTT | 16 | 2161 |
| 1250110 | N/A | N/A | 240470 | 240489 | CATATTTCTTCTCATTCTTA | 59 | 2162 |
| 1250136 | N/A | N/A | 243102 | 243121 | AAGTCAAAAAATTCTATTAA | 83 | 2163 |
| 1250162 | N/A | N/A | 246477 | 246496 | CATCTGGTAAATATTATTTT | 57 | 2164 |
| 1250188 | N/A | N/A | 249349 | 249368 | CATTTTTATTTTAATTGCTT | 21 | 2165 |
| 1250214 | N/A | N/A | 252565 | 252584 | TGCATAATACATAAATGCAA | 54 | 2166 |
| 1250240 | N/A | N/A | 254182 255575 | 254201 255594 | TTACAGCAGGTCGAGGTATG | 60 | 2167 |
| 1250266 | N/A | N/A | 255756 | 255775 | GTCTGGACATTTCATAGGCT | 20 | 2168 |
| 1250292 | N/A | N/A | 258776 | 258795 | TTTCTGACTTTATATTCTCT | 59 | 2169 |
| 1250316 | N/A | N/A | 260872 | 260891 | CAGATCTCAAATCTTACCTC | 55 | 2170 |

TABLE 30

Reduction of SCN2A RNA by 5-10-5 MOE gapmers with
mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910064 | 7753 | 7772 | 264281 | 264300 | GTCGGGCTTTTCATCATTGA | 40 | 116 |
| 910263 | N/A | N/A | 180777 | 180796 | GCACTACCATGCCTTCACCA | 37 | 227 |
| 1248351 | 264 | 283 | 168809 | 168828 | GCCATCTTTTCATCCTGCTC | 29 | 2171 |
| 1248377 | 625 | 644 | 170096 | 170115 | AGCTAATTTTCTAATAGGGT | 20 | 2172 |
| 1248403 | 1224 | 1243 | 183571 | 183590 | TCCTCAATATATTCATCCCA | 36 | 2173 |
| 1248429 | 2310 | 2329 | 199867 | 199886 | CGTCTCTTTCTTATTTCTGT | 18 | 2174 |
| 1248455 | 2510 | 2529 | 204412 | 204431 | GGTGTTTCACCTTTAACCAT | 82 | 2175 |
| 1248481 | 3427 | 3446 | 227421 | 227440 | ATGGTTGGAAATACAGCTGT | 28 | 2176 |
| 1248507 | 3958 | 3977 | 243130 | 243149 | CTCAATGTATATATCTTCAA | 35 | 2177 |
| 1248533 | 4463 | 4482 | 247897 | 247916 | TCACATTTTCCACCTGGCA | 23 | 2178 |
| 1248558 | 6050 | 6069 | 262578 | 262597 | TACTTGATACCTTTTTAACT | 48 | 2179 |
| 1248584 | 6628 | 6647 | 263156 | 263175 | GTGACAATTACTATTATCAA | 45 | 2180 |

TABLE 30-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248610 | 7213 | 7232 | 263741 | 263760 | ATATTTTATTTTATGCCAA | 64 | 2181 |
| 1248635 | 7391 | 7410 | 263919 | 263938 | GGTAAAATTACTATTTACAA | 49 | 2182 |
| 1248661 | 7511 | 7530 | 264039 | 264058 | AACCAATTACATCATATTAC | 45 | 2183 |
| 1248711 | 7993 | 8012 | 264521 | 264540 | CTACACTGCATCCTAGTCCT | 58 | 2184 |
| 1248736 | 8322 | 8341 | 264850 | 264869 | GTAATATAACTTCACTACCT | 50 | 2185 |
| 1248762 | 8435 | 8454 | 264963 | 264982 | GTAACAGCATTTTCCTGCAT | 41 | 2186 |
| 1248788 | 8616 | 8635 | 265144 | 265163 | ATTATAGTAATTAATGTGTG | 68 | 2187 |
| 1248812 | 8737 | 8756 | 265265 | 265284 | ATTTTTGTAACTTTCCACTA | 93 | 2188 |
| 1248838 | N/A | N/A | 113947 | 113966 | TTGCTTTTCTTTAAATGATA | 58 | 2189 |
| 1248864 | N/A | N/A | 117621 | 117640 | TTATAGTTTTTACCCTCAA | 60 | 2190 |
| 1248890 | N/A | N/A | 123821 | 123840 | TCAAATCATTCTACAATTCA | 95 | 2191 |
| 1248916 | N/A | N/A | 127155 | 127174 | CATTTATTTATAAATTATAA | 79 | 2192 |
| 1248941 | N/A | N/A | 128512 128555 | 128531 128574 | ATTGTTAGGATATGGAGTTA | 62 | 2193 |
| 1248967 | N/A | N/A | 140712 | 140731 | GGAGTTTCTTACATATTTTA | 84 | 2194 |
| 1248993 | N/A | N/A | 144287 | 144306 | AATTCTCTCCAAAATAATTA | 74 | 2195 |
| 1249019 | N/A | N/A | 146239 | 146258 | ACCATCTAACTTATTCCTTA | 58 | 2196 |
| 1249045 | N/A | N/A | 148464 | 148483 | TGGAGCTTATATTCTAGGTA | 54 | 2197 |
| 1249071 | N/A | N/A | 152539 | 152558 | ATATTTTTAAAAACTTGGCT | 74 | 2198 |
| 1249097 | N/A | N/A | 156183 | 156202 | TTAAATATTTCCATTTCCTT | 95 | 2199 |
| 1249123 | N/A | N/A | 161836 | 161855 | CTTTCTTATTCCATAGGTTC | 72 | 2200 |
| 1249149 | N/A | N/A | 165819 | 165838 | TTCATTATCCTTATTTGCAA | 52 | 2201 |
| 1249175 | N/A | N/A | 170220 | 170239 | AAGAACACATAACATTGCCA | 51 | 2202 |
| 1249201 | N/A | N/A | 171878 | 171897 | ACTTATTTATTTAATGAATA | 74 | 2203 |
| 1249227 | N/A | N/A | 172639 | 172658 | TACAGCATCTATATACCTCT | 31 | 2204 |
| 1249253 | N/A | N/A | 174408 | 174427 | CCATTTTCAAATGATAGGTA | 40 | 2205 |
| 1249279 | N/A | N/A | 175596 | 175615 | GTCATTATCCACTAAGATAA | 55 | 2206 |
| 1249305 | N/A | N/A | 176843 | 176862 | CAGGCATTTTCCTTATTTCA | 19 | 2207 |
| 1249331 | N/A | N/A | 177679 | 177698 | AAATGTCACCTCTCTTTTTC | 58 | 2208 |
| 1249357 | N/A | N/A | 178317 | 178336 | TGTACTTACATATCTTATCA | 47 | 2209 |
| 1249383 | N/A | N/A | 179765 | 179784 | ATAATGAAATATCAACACTA | 62 | 2210 |
| 1249409 | N/A | N/A | 180452 | 180471 | AAGTAATTAATTAAATGTAT | 97 | 2211 |
| 1249435 | N/A | N/A | 181315 | 181334 | TTGTATTTCATAAAATATGC | 44 | 2212 |
| 1249461 | N/A | N/A | 183652 | 183671 | GAGATAATTTCCATTATATA | 50 | 2213 |
| 1249487 | N/A | N/A | 183978 | 183997 | ATGTTGCATCAACCAAATAG | 40 | 2214 |
| 1249513 | N/A | N/A | 185319 | 185338 | ATTCTCTATTTTACATTGAA | 45 | 2215 |

TABLE 30-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249539 | N/A | N/A | 185779 | 185798 | TGGCTCTAAAATCTTGCTAA | 26 | 2216 |
| 1249565 | N/A | N/A | 187608 | 187627 | ATGTAACCCACAAACTTGCA | 46 | 2217 |
| 1249591 | N/A | N/A | 189975 | 189994 | AAAGGCATTCTTCATAGGCA | 35 | 2218 |
| 1249617 | N/A | N/A | 191905 | 191924 | GTAGTTATTTTTAAAGCCT | 31 | 2219 |
| 1249643 | N/A | N/A | 200273 | 200292 | TAAGCATTTATCATTACACT | 35 | 2220 |
| 1249669 | N/A | N/A | 200681 | 200700 | CATTCAACAACCTTATGCCT | 50 | 2221 |
| 1249695 | N/A | N/A | 202507 | 202526 | TTTAAGTTCTAAAATAAAAT | 65 | 2222 |
| 1249721 | N/A | N/A | 203038 | 203057 | AATGTTTCTTCTACTAATCA | 36 | 2223 |
| 1249747 | N/A | N/A | 203768 | 203787 | CCATCTCTCTACATTTCTCA | 46 | 2224 |
| 1249773 | N/A | N/A | 205479 | 205498 | ATACAGACAATTTATAGTAA | 73 | 2225 |
| 1249799 | N/A | N/A | 207015 | 207034 | AGGAATTTTTCAATTTCACA | 52 | 2226 |
| 1249825 | N/A | N/A | 208862 | 208881 | TCCTTTACATATATTAGATA | 57 | 2227 |
| 1249851 | N/A | N/A | 210347 | 210366 | TCTGATTCTCCCATTATATA | 51 | 2228 |
| 1249877 | N/A | N/A | 213484 | 213503 | CCAAAATTCATCTTACTGCT | 37 | 2229 |
| 1249903 | N/A | N/A | 215849 | 215868 | ATGAACAATTCCATAATTCT | 62 | 2230 |
| 1249929 | N/A | N/A | 220980 | 220999 | GTGTAATTACTTCATATTTA | 31 | 2231 |
| 1249955 | N/A | N/A | 224675 | 224694 | TTATTTCTCACAACTCTATA | 65 | 2232 |
| 1249981 | N/A | N/A | 228316 | 228335 | ATTCAGAATTTTACATTCTA | 45 | 2233 |
| 1250007 | N/A | N/A | 231422 | 231441 | GCAGATAAATATTATACCCA | 28 | 2234 |
| 1250033 | N/A | N/A | 233733 | 233752 | CACTTTTTAATTACCTGTAC | 45 | 2235 |
| 1250059 | N/A | N/A | 235626 | 235645 | ATGGATAATACACCAATATA | 36 | 2236 |
| 1250085 | N/A | N/A | 237498 | 237517 | CATTTGGAAACTACTTGTTA | 70 | 2237 |
| 1250111 | N/A | N/A | 241055 | 241074 | TTGTACAAACTCATTCCTCC | 34 | 2238 |
| 1250137 | N/A | N/A | 243105 | 243124 | TGTAAGTCAAAAAATTCTAT | 75 | 2239 |
| 1250163 | N/A | N/A | 246564 | 246583 | AAGAAGTGAAAATCTAGCTA | 67 | 2240 |
| 1250189 | N/A | N/A | 249785 | 249804 | TGGAAAGTTTTCATTTGCAA | 38 | 2241 |
| 1250215 | N/A | N/A | 253045 | 253064 | TACATTTCTTTAGATAGGCA | 29 | 2242 |
| 1250241 | N/A | N/A | 254208 255601 | 254227 255620 | TAACAGGCAATGAAAATATG | 86 | 2243 |
| 1250267 | N/A | N/A | 255841 | 255860 | TCTATTCTAATTATTTTTCA | 89 | 2244 |
| 1250293 | N/A | N/A | 258834 | 258853 | AACTAATAAATAAATACTTC | 85 | 2245 |
| 1250317 | N/A | N/A | 260876 | 260895 | AGGTCAGATCTCAAATCTTA | 55 | 2246 |

TABLE 31

Reduction of SCN2A RNA by 5-10-5 MOE gapmers with
mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910069 | 7994 | 8013 | 264522 | 264541 | CCTACACTGCATCCTAGTCC | 55 | 39 |
| 910263 | N/A | N/A | 180777 | 180796 | GCACTACCATGCCTTCACCA | 34 | 227 |
| 1248352 | 366 | 385 | 168911 | 168930 | CTCTTAGCTTTCTCTTCTGC | 22 | 2247 |
| 1248378 | 765 | 784 | 181676 | 181695 | TCAAAAGTATAAATTCCTGT | 42 | 2248 |
| 1248404 | 1225 | 1244 | 183572 | 183591 | ATCCTCAATATATTCATCCC | 14 | 2249 |
| 1248430 | 2312 | 2331 | 199869 | 199888 | ACCGTCTCTTTCTTATTTCT | 17 | 2250 |
| 1248456 | 2511 | 2530 | 204413 | 204432 | AGGTGTTTCACCTTTAACCA | 76 | 2251 |
| 1248482 | 3428 | 3447 | 227422 | 227441 | TATGGTTGGAAATACAGCTG | 16 | 2252 |
| 1248508 | 3975 | 3994 | 243147 | 243166 | TTAATGGTTTTCGCTGCTC | 32 | 2253 |
| 1248534 | 4464 | 4483 | 247898 | 247917 | TTCACATTTTTCCACCTGGC | 8 | 2254 |
| 1248559 | 6061 | 6080 | 262589 | 262608 | TTTCTTGTATATACTTGATA | 47 | 2255 |
| 1248585 | 6629 | 6648 | 263157 | 263176 | GGTGACAATTACTATTATCA | 25 | 2256 |
| 1248611 | 7214 | 7233 | 263742 | 263761 | GATATTTTATTTTATGCCA | 33 | 2257 |
| 1248636 | 7392 | 7411 | 263920 | 263939 | GGGTAAAATTACTATTTACA | 34 | 2258 |
| 1248662 | 7512 | 7531 | 264040 | 264059 | GAACCAATTACATCATATTA | 31 | 2259 |
| 1248686 | 7797 | 7816 | 264325 | 264344 | ATATATTTTAAACAGATTTA | 70 | 2260 |
| 1248737 | 8325 | 8344 | 264853 | 264872 | CTGGTAATATAACTTCACTA | 29 | 2261 |
| 1248763 | 8451 | 8470 | 264979 | 264998 | TTTACCGTTCTTTATGGTAA | 72 | 2262 |
| 1248789 | 8623 | 8642 | 265151 | 265170 | AAGATGAATTATAGTAATTA | 66 | 2263 |
| 1248813 | 8740 | 8759 | 265268 | 265287 | TTAATTTTGTAACTTTCCA | 78 | 2264 |
| 1248839 | N/A | N/A | 113966 | 113985 | CCTTATCTCTCAATTACAAT | 82 | 2265 |
| 1248865 | N/A | N/A | 117677 | 117696 | AAGATCATTTATCCCCCTA | 67 | 2266 |
| 1248891 | N/A | N/A | 123949 | 123968 | CTTATGGTCTTTAATAATAA | 72 | 2267 |
| 1248917 | N/A | N/A | 127158 | 127177 | TCACATTTATTTATAAATTA | 105 | 2268 |
| 1248942 | N/A | N/A | 128514 128557 | 128533 128576 | TAATTGTTAGGATATGGAGT | 66 | 2269 |
| 1248968 | N/A | N/A | 140789 | 140808 | GAGAAATGTCCATTTAGGTC | 61 | 2270 |
| 1248994 | N/A | N/A | 144315 | 144334 | AGCACAAGTCCAATTAGGCC | 58 | 2271 |
| 1249020 | N/A | N/A | 146246 | 146265 | TTTAATCACCATCTAACTTA | 79 | 2272 |
| 1249046 | N/A | N/A | 148566 | 148585 | GCTAATCATTTAACAAAAAT | 86 | 2273 |
| 1249072 | N/A | N/A | 152563 | 152582 | ATTTTATATATAATTACTAA | 66 | 2274 |
| 1249098 | N/A | N/A | 156216 | 156235 | GAACTTATCTTCCTTAGAAA | 69 | 2275 |
| 1249124 | N/A | N/A | 162088 | 162107 | ACATAATTTTATATTAGTTT | 113 | 2276 |
| 1249150 | N/A | N/A | 165938 | 165957 | GCTAGGCTTTCAATTAATAT | 77 | 2277 |
| 1249176 | N/A | N/A | 170274 | 170293 | CCTGTGATCTCATTTTGCAA | 44 | 2278 |
| 1249202 | N/A | N/A | 171885 | 171904 | ACTAGTCACTTATTTATTTA | 39 | 2279 |

TABLE 31-continued

Reduction of SCN2A RNA by 5-10-5 MOE gapmers with
mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249228 | N/A | N/A | 172640 | 172659 | CTACAGCATCTATATACCTC | 34 | 2280 |
| 1249254 | N/A | N/A | 174412 | 174431 | CCTACCATTTTCAAATGATA | 48 | 2281 |
| 1249280 | N/A | N/A | 175597 | 175616 | AGTCATTATCCACTAAGATA | 42 | 2282 |
| 1249306 | N/A | N/A | 176844 | 176863 | ACAGGCATTTTCCTTATTTC | 10 | 2283 |
| 1249332 | N/A | N/A | 177749 | 177768 | TACTGTAATTATTTTAGGTT | 60 | 2284 |
| 1249358 | N/A | N/A | 178320 | 178339 | ATCTGTACTTACATATCTTA | 33 | 2285 |
| 1249384 | N/A | N/A | 179781 | 179800 | ATCACATTACTTACACATAA | 28 | 2286 |
| 1249410 | N/A | N/A | 180456 | 180475 | ATTCAAGTAATTAATTAAAT | 77 | 2287 |
| 1249436 | N/A | N/A | 181432 | 181451 | ATTAATTAATTTAAAGGATC | 92 | 2288 |
| 1249462 | N/A | N/A | 183672 | 183691 | ACTTGATTCACATCTAAATT | 24 | 2289 |
| 1249488 | N/A | N/A | 183997 | 184016 | GCATATGTACTCAATACATA | 34 | 2290 |
| 1249514 | N/A | N/A | 185322 | 185341 | TTTATTCTCTATTTTACATT | 71 | 2291 |
| 1249540 | N/A | N/A | 185780 | 185799 | GTGGCTCTAAAATCTTGCTA | 38 | 2292 |
| 1249566 | N/A | N/A | 187837 | 187856 | CTTTATTACATATTTAGGAA | 82 | 2293 |
| 1249592 | N/A | N/A | 189977 | 189996 | TTAAAGGCATTCTTCATAGG | 44 | 2294 |
| 1249618 | N/A | N/A | 192377 | 192396 | GTGATTCTATTCATTATTTA | 34 | 2295 |
| 1249644 | N/A | N/A | 200292 | 200311 | CTTAGCATCATCATAAGTAT | 29 | 2296 |
| 1249670 | N/A | N/A | 200689 | 200708 | ATTTAATCCATTCAACAACC | 64 | 2297 |
| 1249696 | N/A | N/A | 202508 | 202527 | GTTTAAGTTCTAAAATAAAA | 99 | 2298 |
| 1249722 | N/A | N/A | 203161 | 203180 | TCAGTCACTTTAATACTATT | 25 | 2299 |
| 1249748 | N/A | N/A | 203770 | 203789 | TTCCATCTCTCTACATTTCT | 26 | 2300 |
| 1249774 | N/A | N/A | 205535 | 205554 | TTCAGACCTTCCATTTCTCT | 27 | 2301 |
| 1249800 | N/A | N/A | 207030 | 207049 | CGCTTGTTACTCCCTAGGAA | 11 | 2302 |
| 1249826 | N/A | N/A | 208866 | 208885 | ATAATCCTTTACATATATTA | 74 | 2303 |
| 1249852 | N/A | N/A | 210369 | 210388 | TCCATTCTTTCTATTTTCTC | 18 | 2304 |
| 1249878 | N/A | N/A | 213508 | 213527 | CCAGGCATCTCAAATTCAAC | 30 | 2305 |
| 1249904 | N/A | N/A | 216015 | 216034 | ACTTTCTTTAAAATTAACAA | 90 | 2306 |
| 1249930 | N/A | N/A | 221026 | 221045 | AGTCATTTTTCTATTCCATT | 11 | 2307 |
| 1249956 | N/A | N/A | 224726 | 224745 | CTCTTAGTAAATACCAGTTA | 26 | 2308 |
| 1249982 | N/A | N/A | 228460 | 228479 | TTTAAATTCCTCTCTTTACC | 74 | 2309 |
| 1250008 | N/A | N/A | 231424 | 231443 | AAGCAGATAAATATTATACC | 47 | 2310 |
| 1250034 | N/A | N/A | 233839 | 233858 | GTGAAATACTACATTAGTAA | 21 | 2311 |
| 1250060 | N/A | N/A | 235627 235682 | 235646 235701 | TATGGATAATACACCAATAT | 26 | 2312 |
| 1250086 | N/A | N/A | 237593 | 237612 | TTCTAATTCCAAAAGAGCA | 46 | 2313 |
| 1250112 | N/A | N/A | 241548 | 241567 | TAGCGAATCAGTGTGAAGAA | 34 | 2314 |

TABLE 31-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250138 | N/A | N/A | 243124 | 243143 | GTATATATCTTCAAAGGCCT | 16 | 2315 |
| 1250164 | N/A | N/A | 246602 | 246621 | CTTGATTCAAATCAGCAGCA | 20 | 2316 |
| 1250190 | N/A | N/A | 250030 | 250049 | TACTGCATTTCCTTTTTAA | 28 | 2317 |
| 1250216 | N/A | N/A | 253049 | 253068 | ATAATACATTTCTTTAGATA | 72 | 2318 |
| 1250242 | N/A | N/A | 254373 | 254392 | GTTATGCATTATATAATTTA | 64 | 2319 |
| 1250268 | N/A | N/A | 255845 | 255864 | TTTCTCTATTCTAATTATTT | 65 | 2320 |
| 1250294 | N/A | N/A | 258972 | 258991 | ACCAGGTTTTATAAACTCAC | 36 | 2321 |
| 1250318 | N/A | N/A | 261001 | 261020 | ATAATCTGATTTAATCCTCA | 72 | 2322 |

TABLE 32

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 15 | 227 |
| 1248353 | 369 | 388 | 168914 | 168933 | GGTCTCTTAGCTTTCTCTTC | 18 | 2323 |
| 1248379 | 784 | 803 | 181695 | 181714 | AAGTATTTTAATAAGTGATT | 82 | 2324 |
| 1248405 | 1227 | 1246 | 183574 | 183593 | TTATCCTCAATATATTCATC | 68 | 2325 |
| 1248431 | 2313 | 2332 | 199870 | 199889 | GACCGTCTCTTTCTTATTTC | 29 | 2326 |
| 1248457 | 2512 | 2531 | 204414 | 204433 | AAGGTGTTTCACCTTTAACC | 66 | 2327 |
| 1248483 | 3429 | 3448 | 227423 | 227442 | GTATGGTTGGAAATACAGCT | 33 | 2328 |
| 1248509 | 3985 | 4004 | 243157 | 243176 | TAACATGGTCTTAATGGTTT | 49 | 2329 |
| 1248535 | 4468 | 4487 | 247902 | 247921 | TACTTTCACATTTTTCCACC | 29 | 2330 |
| 1248560 | 6093 | 6112 | 262621 | 262640 | ATGGGTGTTCCATCACATTC | 38 | 2331 |
| 1248586 | 6630 | 6649 | 263158 | 263177 | TGGTGACAATTACTATTATC | 39 | 2332 |
| 1248612 | 7215 | 7234 | 263743 | 263762 | GGATATTTTATTTTATGCC | 24 | 2333 |
| 1248637 | 7393 | 7412 | 263921 | 263940 | TGGGTAAAATTACTATTTAC | 55 | 2334 |
| 1248663 | 7515 | 7534 | 264043 | 264062 | ATGGAACCAATTACATCATA | 41 | 2335 |
| 1248687 | 7799 | 7818 | 264327 | 264346 | CCATATATTTTAAACAGATT | 63 | 2336 |
| 1248712 | 8000 | 8019 | 264528 | 264547 | CAGAAACCTACACTGCATCC | 62 | 2337 |
| 1248738 | 8327 | 8346 | 264855 | 264874 | AACTGGTAATATAACTTCAC | 40 | 2338 |
| 1248764 | 8484 | 8503 | 265012 | 265031 | AACCTTTATTCTTTTGGCTT | 52 | 2339 |
| 1248790 | 8648 | 8667 | 265176 | 265195 | AACTTCCATTCCATGAAAAA | 63 | 2340 |
| 1248814 | 8752 | 8771 | 265280 | 265299 | GTCAATTTTTTATTAATTTT | 82 | 2341 |
| 1248840 | N/A | N/A | 113976 | 113995 | GGGAAATCCACCTTATCTCT | 62 | 2342 |

TABLE 32-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248866 | N/A | N/A | 117690 | 117709 | GCAATTTCTTCCTAAGATCA | 94 | 2343 |
| 1248892 | N/A | N/A | 123960 | 123979 | GTTGATTACTCCTTATGGTC | 53 | 2344 |
| 1248918 | N/A | N/A | 127253 | 127272 | CAGTACTTAAAAATATATTA | 90 | 2345 |
| 1248943 | N/A | N/A | 128520 128563 | 128539 128582 | TTTTAATAATTGTTAGGATA | 57 | 2346 |
| 1248969 | N/A | N/A | 140835 | 140854 | TGGGAATTTTATCATACACT | 66 | 2347 |
| 1248995 | N/A | N/A | 144516 | 144535 | GTCTACTTCCTATTTTCCAT | 43 | 2348 |
| 1249021 | N/A | N/A | 146247 | 146266 | CTTTAATCACCATCTAACTT | 82 | 2349 |
| 1249047 | N/A | N/A | 148586 | 148605 | CTTTCAGTATTTACAATCCA | 69 | 2350 |
| 1249073 | N/A | N/A | 152567 | 152586 | ATCTATTTTATATATAATTA | 86 | 2351 |
| 1249099 | N/A | N/A | 156232 | 156251 | GAACATTTCCAAAATTGAAC | 87 | 2352 |
| 1249125 | N/A | N/A | 162139 | 162158 | TAGAAATAAATTTATACTAA | 59 | 2353 |
| 1249151 | N/A | N/A | 165997 | 166016 | ATTTAAGTCACTAAAAAGCA | 111 | 2354 |
| 1249177 | N/A | N/A | 170466 | 170485 | GAGTTTACTCCCTTACCTAA | 41 | 2355 |
| 1249203 | N/A | N/A | 171897 | 171916 | AATCTCTGACTTACTAGTCA | 39 | 2356 |
| 1249229 | N/A | N/A | 172641 | 172660 | ACTACAGCATCTATATACCT | 44 | 2357 |
| 1249255 | N/A | N/A | 174417 | 174436 | ATTTTCCTACCATTTTCAAA | 75 | 2358 |
| 1249281 | N/A | N/A | 175601 | 175620 | ATACAGTCATTATCCACTAA | 53 | 2359 |
| 1249307 | N/A | N/A | 176882 | 176901 | TAATTATTTTCTAATTAGTC | 79 | 2360 |
| 1249333 | N/A | N/A | 177770 | 177789 | GCATTATCCCCATTTGGATA | 41 | 2361 |
| 1249359 | N/A | N/A | 178353 | 178372 | TCTGAATTCCACATACTTGA | 46 | 2362 |
| 1249385 | N/A | N/A | 179785 | 179804 | AATGATCACATTACTTACAC | 47 | 2363 |
| 1249411 | N/A | N/A | 180476 | 180495 | GGCAAAAATTCAACAAGACA | 36 | 2364 |
| 1249437 | N/A | N/A | 181443 | 181462 | GCATTTTCCACATTAATTAA | 30 | 2365 |
| 1249463 | N/A | N/A | 183697 | 183716 | AAATCATCTTAAATTAGTCT | 87 | 2366 |
| 1249489 | N/A | N/A | 184042 | 184061 | ATTCTTATTTCATCTTGATA | 54 | 2367 |
| 1249515 | N/A | N/A | 185324 | 185343 | GCTTTATTCTCTATTTTACA | 25 | 2368 |
| 1249541 | N/A | N/A | 185841 | 185860 | GGTATTAGCTACTAATGTCC | 41 | 2369 |
| 1249567 | N/A | N/A | 187845 | 187864 | ACTTTGACCTTTATTACATA | 37 | 2370 |
| 1249593 | N/A | N/A | 190062 | 190081 | TCTATATTATAAAAGGTAA | 150 | 2371 |
| 1249619 | N/A | N/A | 192381 | 192400 | TTATGTGATTCTATTCATTA | 99 | 2372 |
| 1249645 | N/A | N/A | 200310 | 200329 | TTAATATAATCCAAATGGCT | 56 | 2373 |
| 1249671 | N/A | N/A | 200697 | 200716 | GAAGGCTTATTTAATCCATT | 30 | 2374 |
| 1249697 | N/A | N/A | 202643 | 202662 | TGCCAGCTGTCATTTAGCAA | 38 | 2375 |
| 1249723 | N/A | N/A | 203163 | 203182 | AGTCAGTCACTTTAATACTA | 38 | 2376 |
| 1249749 | N/A | N/A | 203773 | 203792 | AAGTTCCATCTCTCTACATT | 33 | 2377 |

TABLE 32-continued

Reduction of SCN2A RNA by 5-10-5 MOE gapmers with
mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249775 | N/A | N/A | 205663 | 205682 | AAGAAATTCTTACATAGCTC | 39 | 2378 |
| 1249801 | N/A | N/A | 207058 | 207077 | GTCTATTACTTCTTGAGTCA | 33 | 2379 |
| 1249827 | N/A | N/A | 208871 | 208890 | TTATAATAATCCTTTACATA | 69 | 2380 |
| 1249853 | N/A | N/A | 210376 | 210395 | GCTCTGTTCCATTCTTTCTA | 38 | 2381 |
| 1249879 | N/A | N/A | 213542 | 213561 | GCCTATTCAATACCTACATT | 72 | 2382 |
| 1249905 | N/A | N/A | 216017 | 216036 | ATACTTTCTTTAAAATTAAC | 111 | 2383 |
| 1249931 | N/A | N/A | 221909 | 221928 | AGAGGATTTTCTCCTTGCCT | 42 | 2384 |
| 1249957 | N/A | N/A | 224770 | 224789 | CAGATCATAATAACAATAAA | 94 | 2385 |
| 1249983 | N/A | N/A | 228556 | 228575 | ATCTTGTTTTCCTTGTTA | 27 | 2386 |
| 1250009 | N/A | N/A | 231442 | 231461 | GCCATTTTCCCTAAAATGAA | 41 | 2387 |
| 1250035 | N/A | N/A | 233992 | 234011 | TTTAAGGTCATAATTACGAT | 36 | 2388 |
| 1250061 | N/A | N/A | 235628 | 235647 | ATATGGATAATACACCAATA | 47 | 2389 |
| 1250087 | N/A | N/A | 237601 | 237620 | CTATAATTTTCTAATTCCAA | 62 | 2390 |
| 1250113 | N/A | N/A | 241550 | 241569 | AATAGCGAATCAGTGTGAAG | 42 | 2391 |
| 1250139 | N/A | N/A | 243457 | 243476 | TATATGTATTTAAATTGGTA | 94 | 2392 |
| 1250165 | N/A | N/A | 246605 | 246624 | AATCTTGATTCAAATCAGCA | 30 | 2393 |
| 1250191 | N/A | N/A | 250041 | 250060 | ACAATATATTCTACTGCATT | 48 | 2394 |
| 1250217 | N/A | N/A | 253122 | 253141 | TTAACTATATTAACATATAA | 96 | 2395 |
| 1250243 | N/A | N/A | 254524 | 254543 | GAACATTTAATATTTTCACA | 64 | 2396 |
| 1250269 | N/A | N/A | 255848 | 255867 | TTTTTTCTCTATTCTAATTA | 104 | 2397 |
| 1250295 | N/A | N/A | 259097 | 259116 | ACAATGTTCTATTCTATTAA | 64 | 2398 |
| 1250319 | N/A | N/A | 261296 | 261315 | TTTATATGTCCAAAATACTA | 89 | 2399 |

TABLE 33

Reduction of SCN2A RNA by 5-10-5 MOE gapmers with
mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 910263 | N/A | N/A | 180777 | 180796 | GCACTACCATGCCTTCACCA | 29 | 227 |
| 1248354 | 371 | 390 | 168916 | 168935 | TGGGTCTCTTAGCTTTCTCT | 21 | 2400 |
| 1248380 | 786 | 805 | 181697 | 181716 | GCAAGTATTTAATAAGTGA | 30 | 2401 |
| 1248406 | 1228 | 1247 | 183575 | 183594 | TTTATCCTCAATATATTCAT | 27 | 2402 |
| 1248432 | 2317 | 2336 | 199874 | 199893 | ACTGGACCGTCTCTTTCTTA | 38 | 2403 |
| 1248458 | 2513 | 2532 | 204415 | 204434 | CAAGGTGTTTCACCTTTAAC | 54 | 2404 |

TABLE 33-continued

Reduction of SCN2A RNA by 5-10-5 MOE gapmers with mixed PO/PS internucleoside linkages at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1248484 | 3431 | 3450 | 227425 | 227444 | TGGTATGGTTGGAAATACAG | 24 | 2405 |
| 1248510 | 3994 | 4013 | 243166 | 243185 | AGCATATTCTAACATGGTCT | 15 | 2406 |
| 1248536 | 4503 | 4522 | 247937 | 247956 | AGAGACAGATATCCAAGTCC | 33 | 2407 |
| 1248561 | 6135 | 6154 | 262663 | 262682 | GTTGAATTCTCATTCAGTTT | 44 | 2408 |
| 1248587 | 6825 | 6844 | 263353 | 263372 | AAATATATCCAGTTATACAA | 53 | 2409 |
| 1248613 | 7216 | 7235 | 263744 | 263763 | AGGATATTTTTATTTATGC | 29 | 2410 |
| 1248638 | 7394 | 7413 | 263922 | 263941 | CTGGGTAAAATTACTATTTA | 51 | 2411 |
| 1248664 | 7517 | 7536 | 264045 | 264064 | TAATGGAACCAATTACATCA | 37 | 2412 |
| 1248688 | 7800 | 7819 | 264328 | 264347 | ACCATATATTTTAAACAGAT | 51 | 2413 |
| 1248713 | 8002 | 8021 | 264530 | 264549 | AGCAGAAACCTACACTGCAT | 53 | 2414 |
| 1248739 | 8328 | 8347 | 264856 | 264875 | TAACTGGTAATATAACTTCA | 43 | 2415 |
| 1248765 | 8485 | 8504 | 265013 | 265032 | AAACCTTTATTCTTTTGGCT | 38 | 2416 |
| 1248791 | 8650 | 8669 | 265178 | 265197 | TTAACTTCCATTCCATGAAA | 64 | 2417 |
| 1248815 | 8754 | 8773 | 265282 | 265301 | TAGTCAATTTTTTATTAATT | 94 | 2418 |
| 1248841 | N/A | N/A | 114398 | 114417 | ACAATCTTTTCTATTAGGTA | 52 | 2419 |
| 1248867 | N/A | N/A | 117733 | 117752 | AAACTATAAAAATAATCTAA | 71 | 2420 |
| 1248893 | N/A | N/A | 123985 | 124004 | ATTATATTAAATCATATTTT | 65 | 2421 |
| 1248919 | N/A | N/A | 127286 | 127305 | AATAAGATCCAAAATAGTAA | 88 | 2422 |
| 1248944 | N/A | N/A | 128521 128564 | 128540 128583 | ATTTTAATAATTGTTAGGAT | 108 | 2423 |
| 1248970 | N/A | N/A | 141313 | 141332 | ATTATCTTTTTATATGCCC | 61 | 2424 |
| 1248996 | N/A | N/A | 144674 | 144693 | TAGAAATATTCTACATCTTA | 71 | 2425 |
| 1249022 | N/A | N/A | 146255 | 146274 | ATTCAACTCTTTAATCACCA | 59 | 2426 |
| 1249048 | N/A | N/A | 149090 | 149109 | TCTTACTCTCCTACTTTCTA | 62 | 2427 |
| 1249074 | N/A | N/A | 152570 | 152589 | TCCATCTATTTTATATATAA | 64 | 2428 |
| 1249100 | N/A | N/A | 156409 | 156428 | CATCTCTCCTCATATTCATT | 60 | 2429 |
| 1249126 | N/A | N/A | 162345 | 162364 | ATACTCTTTTCCTTTAGTTT | 69 | 2430 |
| 1249152 | N/A | N/A | 166019 | 166038 | ACACCAATCTTATTTATCTC | 54 | 2431 |
| 1249178 | N/A | N/A | 170511 | 170530 | TATTTATTTTCCAAATGTAA | 43 | 2432 |
| 1249204 | N/A | N/A | 171907 | 171926 | CTGATTCTCTAATCTCTGAC | 26 | 2433 |
| 1249230 | N/A | N/A | 172642 | 172661 | AACTACAGCATCTATATACC | 43 | 2434 |
| 1249256 | N/A | N/A | 174418 | 174437 | CATTTTCCTACCATTTTCAA | 66 | 2435 |
| 1249282 | N/A | N/A | 175698 | 175717 | GATACATCCCTTACCAGCCA | 27 | 2436 |
| 1249308 | N/A | N/A | 176888 | 176907 | GAGAAATAATTATTTTCTAA | 53 | 2437 |
| 1249334 | N/A | N/A | 177771 | 177790 | TGCATTATCCCCATTTGGAT | 33 | 2438 |
| 1249360 | N/A | N/A | 178407 | 178426 | TAACCATTATATACCCACCA | 48 | 2439 |

TABLE 33-continued

Reduction of SCN2A RNA by 5-10-5 MOE gapmers with
mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1249386 | N/A | N/A | 179788 | 179807 | ATAAATGATCACATTACTTA | 55 | 2440 |
| 1249412 | N/A | N/A | 180491 | 180510 | ACATATGTAAACCCTGGCAA | 50 | 2441 |
| 1249438 | N/A | N/A | 181444 | 181463 | TGCATTTTCCACATTAATTA | 24 | 2442 |
| 1249464 | N/A | N/A | 183698 | 183717 | TAAATCATCTTAAATTAGTC | 68 | 2443 |
| 1249490 | N/A | N/A | 184276 | 184295 | TTTATATTCACATACAAACA | 78 | 2444 |
| 1249516 | N/A | N/A | 185362 | 185381 | CTTAAGAATTCTATTAAGCT | 49 | 2445 |
| 1249542 | N/A | N/A | 185943 | 185962 | ATCAATTGATTTACTTATCA | 83 | 2446 |
| 1249568 | N/A | N/A | 188039 | 188058 | GTCTGAATTATTAAATGTAA | 54 | 2447 |
| 1249594 | N/A | N/A | 190063 | 190082 | GTCTATATTATAAAAAGGTA | 32 | 2448 |
| 1249620 | N/A | N/A | 192453 | 192472 | AGCTAAAGAATTACTTTTTC | 41 | 2449 |
| 1249646 | N/A | N/A | 200315 | 200334 | AGCAGTTAATATAATCCAAA | 27 | 2450 |
| 1249672 | N/A | N/A | 200750 | 200769 | ATAATATTTATTAACTGTCT | 43 | 2451 |
| 1249698 | N/A | N/A | 202720 | 202739 | TTACAGTAAATAACAAAAAA | 91 | 2452 |
| 1249724 | N/A | N/A | 203194 | 203213 | TTCTTTTTAAATCCATGGCA | 29 | 2453 |
| 1249750 | N/A | N/A | 203776 | 203795 | ACAAAGTTCCATCTCTCTAC | 39 | 2454 |
| 1249776 | N/A | N/A | 205718 | 205737 | CTTTCTTGTTTCAATTGCCA | 31 | 2455 |
| 1249802 | N/A | N/A | 207283 | 207302 | CTGGCATTAATATCAGGGTA | 15 | 2456 |
| 1249828 | N/A | N/A | 208931 | 208950 | TATGTCTATTCAAATATTTT | 65 | 2457 |
| 1249854 | N/A | N/A | 210392 | 210411 | GTTTCTTCAAATATTTGCTC | 24 | 2458 |
| 1249880 | N/A | N/A | 213546 | 213565 | ACCTGCCTATTCAATACCTA | 78 | 2459 |
| 1249906 | N/A | N/A | 216211 | 216230 | AGGTAAATCATCTATAGGAA | 27 | 2460 |
| 1249932 | N/A | N/A | 222126 | 222145 | ATCAAATCTATAACATAATT | 83 | 2461 |
| 1249958 | N/A | N/A | 224957 | 224976 | CTGTGACATTTATATAGCCT | 28 | 2462 |
| 1249984 | N/A | N/A | 229045 | 229064 | TTAGTAATTTTATCAAATAA | 65 | 2463 |
| 1250010 | N/A | N/A | 231465 | 231484 | GGTCAACTCCTAAATAAAGC | 21 | 2464 |
| 1250036 | N/A | N/A | 234115 | 234134 | TTAAAATTACATTCTAGGCA | 39 | 2465 |
| 1250062 | N/A | N/A | 235629 | 235648 | CATATGGATAATACACCAAT | 48 | 2466 |
| 1250088 | N/A | N/A | 237608 | 237627 | ATATATTCTATAATTTTCTA | 84 | 2467 |
| 1250114 | N/A | N/A | 241552 | 241571 | GCAATAGCGAATCAGTGTGA | 23 | 2468 |
| 1250140 | N/A | N/A | 243479 | 243498 | ATTTGATTTTATCTATGAA | 69 | 2469 |
| 1250166 | N/A | N/A | 246776 | 246795 | CTTTTTAGCCATTTCAGCCT | 42 | 2470 |
| 1250192 | N/A | N/A | 250174 | 250193 | TTATTCTTTTCTAAATGATT | 53 | 2471 |
| 1250218 | N/A | N/A | 253216 | 253235 | GTCAAAACTTTTAAGATTTA | 47 | 2472 |
| 1250244 | N/A | N/A | 254626 | 254645 | GCCTGTTTCATTAATGATTC | 51 | 2473 |
| 1250270 | N/A | N/A | 256686 | 256705 | TGATAGCTCACAAATCCATC | 50 | 2474 |
| 1250296 | N/A | N/A | 259151 | 259170 | CTTAATGCTACCTCATAGCA | 53 | 2475 |

TABLE 33-continued

Reduction of SCN2A RNA by 5-10-5 MOE gapmers with
mixed PO/PS internucleoside linkages
at 4000 nM concentration in SH-SY5Y cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | SCN2A (% control) | SEQ ID NO |
|---|---|---|---|---|---|---|---|
| 1250320 | N/A | N/A | 260853 261310 | 260872 261329 | AGTACAGAAATTAATTTATA | 95 | 2476 |

Example 2: Effect of Modified Oligonucleotides on Human SCN2A RNA In Vitro, Multiple Doses Modified oligonucleotides selected from Example 1 above were tested at various doses in SH-SY5Y cells. Cultured. SH-SY5Y cells at a density of 20,000 cells per well were treated using electroporation with various concentrations of modified oligonucleotide as specified in the tables below. After a treatment period of approximately 24 hours, total RNA was isolated from the cells and SCN2A RNA levels were measured by quantitative real-time RTPCR. Human SCN2A primer-probe set RTS36041 (described herein in Example 1) was used to measure RNA levels as described above. SCN2A RNA levels were normalized to total RNA content, as measured by RIBOGREEN®. Reduction of SCN2A RNA is presented in the tables below as percent SCN2A RNA relative to the amount in untreated control cells (% control).

The half maximal inhibitory concentration ($IC_{50}$) of each modified oligonucleotide was calculated using a linear regression of a log/linear plot of the data in Excel.

TABLE 34

Dose-dependent reduction of human SCN2A RNA in SH-SY5Y cells by modified oligonucleotides

| Compound ID | SCN2A RNA (% control) | | | | $IC_{50}$ (µM) |
|---|---|---|---|---|---|
| | 80.0 nM | 400.0 nM | 2000.0 nM | 10000.0 nM | |
| 909951 | 126 | 64 | 30 | 8 | 0.79 |
| 909987 | 141 | 88 | 40 | 21 | 1.99 |
| 909981 | 136 | 84 | 50 | 14 | 1.95 |
| 909945 | 109 | 66 | 32 | 13 | 0.89 |
| 910381 | 145 | 86 | 46 | 15 | 1.91 |
| 910279 | 95 | 52 | 31 | 5 | 0.71 |
| 909958 | 92 | 61 | 34 | 20 | 1.00 |
| 909988 | 115 | 54 | 22 | 15 | 0.97 |
| 909946 | 99 | 66 | 46 | 11 | 1.23 |
| 910256 | 77 | 44 | 25 | 12 | 0.41 |
| 910023 | 97 | 73 | 47 | 38 | 2.63 |
| 910376 | 100 | 92 | 70 | 29 | 4.23 |

TABLE 34-continued

Dose-dependent reduction of human SCN2A RNA in SH-SY5Y cells by modified oligonucleotides

| Compound ID | SCN2A RNA (% control) | | | | $IC_{50}$ (µM) |
|---|---|---|---|---|---|
| | 80.0 nM | 400.0 nM | 2000.0 nM | 10000.0 nM | |
| 910269 | 54 | 40 | 34 | 30 | 0.10 |
| 910263 | 78 | 61 | 42 | 20 | 0.91 |
| 909947 | 68 | 54 | 27 | 14 | 0.41 |
| 910335 | 84 | 71 | 36 | 18 | 1.05 |
| 909989 | 91 | 70 | 39 | 41 | 1.11 |
| 910329 | 88 | 69 | 49 | 41 | 2.82 |
| 910342 | 78 | 58 | 39 | 15 | 0.75 |

TABLE 35

Dose-dependent reduction of human SCN2A RNA in SH-SY5Y cells by modified oligonucleotides

| Compound ID | SCN2A RNA (% control) | | | | $IC_{50}$ (µM) |
|---|---|---|---|---|---|
| | 80.0 nM | 400.0 nM | 2000.0 nM | 10000.0 nM | |
| 910342 | 91 | 60 | 19 | 22 | 0.54 |
| 910258 | 91 | 71 | 32 | 21 | 1.14 |
| 910330 | 95 | 90 | 57 | 22 | 2.51 |
| 910246 | 70 | 40 | 19 | 2 | 0.27 |
| 910366 | 95 | 66 | 32 | 10 | 0.93 |
| 910378 | 80 | 75 | 43 | 29 | 1.60 |
| 910355 | 71 | 58 | 22 | 7 | 0.43 |
| 909955 | 70 | 43 | 15 | 5 | 0.27 |
| 909985 | 83 | 46 | 23 | 26 | 0.42 |
| 909967 | 97 | 88 | 54 | 36 | 3.56 |
| 910265 | 83 | 55 | 22 | 19 | 0.63 |
| 910319 | 82 | 79 | 58 | 30 | 2.72 |
| 909980 | 102 | 64 | 43 | 23 | 1.47 |
| 910015 | 83 | 55 | 27 | 11 | 0.61 |
| 909950 | 84 | 63 | 31 | 12 | 0.76 |
| 909962 | 72 | 63 | 40 | 9 | 0.66 |
| 909956 | 88 | 81 | 46 | 26 | 1.85 |
| 910356 | 80 | 54 | 41 | 21 | 0.81 |
| 909951 | 74 | 52 | 38 | 12 | 0.54 |

TABLE 36

Dose-dependent reduction of human SCN2A RNA in SH-SY5Y cells by modified oligonucleotides

| Compound ID | SCN2A RNA (% control) | | | | $IC_{50}$ (µM) |
|---|---|---|---|---|---|
| | 78.125 nM | 313.5 nM | 1250.0 nM | 5000.0 nM | |
| 910263 | 99 | 65 | 38 | 20 | 0.84 |
| 1248511 | 101 | 61 | 31 | 26 | 0.80 |
| 1249205 | 75 | 60 | 35 | 10 | 0.45 |
| 1248355 | 76 | 53 | 26 | 16 | 0.38 |
| 1248485 | 71 | 47 | 27 | 14 | 0.30 |

TABLE 36-continued

Dose-dependent reduction of human SCN2A RNA in SH-SY5Y cells by modified oligonucleotides

| Compound ID | SCN2A RNA (% control) | | | | IC$_{50}$ (µM) |
|---|---|---|---|---|---|
| | 78.125 nM | 313.5 nM | 1250.0 nM | 5000.0 nM | |
| 1249569 | 74 | 68 | 44 | 21 | 0.72 |
| 1249335 | 82 | 61 | 38 | 20 | 0.64 |
| 1249257 | 77 | 70 | 41 | 25 | 0.78 |
| 1250271 | 98 | 94 | 84 | 55 | >5.0 |
| 1248512 | 100 | 83 | 35 | 18 | 0.95 |
| 1249258 | 84 | 60 | 38 | 14 | 0.59 |
| 1249284 | 77 | 55 | 33 | 15 | 0.45 |
| 1249336 | 71 | 57 | 27 | 20 | 0.39 |
| 1249726 | 80 | 60 | 32 | 23 | 0.57 |
| 1248356 | 82 | 58 | 33 | 17 | 0.53 |
| 1249232 | 69 | 55 | 32 | 17 | 0.37 |
| 1250246 | 91 | 68 | 40 | 17 | 0.78 |
| 1248486 | 111 | 67 | 51 | 29 | 1.35 |
| 1250064 | 100 | 68 | 36 | 23 | 0.89 |

TABLE 37

Dose-dependent reduction of human SCN2A RNA in SH-SY5Y cells by modified oligonucleotides

| Compound ID | SCN2A RNA (% control) | | | | IC$_{50}$ (µM) |
|---|---|---|---|---|---|
| | 78.125 nM | 313.5 nM | 1250.0 nM | 5000.0 nM | |
| 910263 | 108 | 65 | 36 | 22 | 0.89 |
| 1249337 | 98 | 60 | 30 | 24 | 0.74 |
| 1248461 | 68 | 55 | 23 | 11 | 0.30 |
| 1248487 | 75 | 54 | 31 | 19 | 0.43 |
| 1249675 | 79 | 53 | 25 | 12 | 0.39 |
| 1248357 | 72 | 66 | 37 | 22 | 0.59 |
| 1249207 | 79 | 61 | 34 | 15 | 0.52 |
| 1250065 | 80 | 56 | 38 | 16 | 0.53 |
| 1250117 | 91 | 79 | 46 | 19 | 1.02 |
| 1249285 | 98 | 87 | 53 | 26 | 1.53 |
| 1249390 | 70 | 42 | 34 | 12 | 0.27 |
| 1249416 | 74 | 46 | 36 | 15 | 0.37 |
| 1248462 | 73 | 38 | 36 | 12 | 0.29 |
| 1249338 | 78 | 45 | 29 | 11 | 0.35 |
| 1249286 | 78 | 62 | 33 | 15 | 0.52 |
| 1249598 | 87 | 80 | 49 | 24 | 1.16 |
| 1249728 | 92 | 54 | 25 | 10 | 0.49 |
| 1249754 | 110 | 63 | 45 | 20 | 0.99 |
| 1248358 | 115 | 56 | 33 | 12 | 0.74 |

TABLE 38

Dose-dependent reduction of human SCN2A RNA in SH-SY5Y cells by modified oligonucleotides

| Compound ID | SCN2A RNA (% control) | | | | IC$_{50}$ (µM) |
|---|---|---|---|---|---|
| | 78.125 nM | 313.5 nM | 1250.0 nM | 5000.0 nM | |
| 910263 | 128 | 79 | 33 | 22 | 1.13 |
| 1249417 | 65 | 41 | 15 | 9 | 0.18 |
| 1249313 | 76 | 38 | 24 | 7 | 0.27 |
| 1249729 | 73 | 47 | 18 | 9 | 0.28 |
| 1248385 | 75 | 61 | 30 | 12 | 0.44 |
| 1249495 | 92 | 60 | 33 | 16 | 0.62 |
| 1248489 | 80 | 62 | 28 | 8 | 0.46 |
| 1250119 | 101 | 81 | 47 | 23 | 1.23 |
| 1249599 | 87 | 81 | 43 | 18 | 0.95 |
| 1249755 | 100 | 76 | 48 | 20 | 1.12 |
| 1249677 | 91 | 72 | 40 | 21 | 0.88 |

TABLE 38-continued

Dose-dependent reduction of human SCN2A RNA
in SH-SY5Y cells by modified oligonucleotides

| Compound ID | SCN2A RNA (% control) | | | | IC$_{50}$ (µM) |
|---|---|---|---|---|---|
| | 78.125 nM | 313.5 nM | 1250.0 nM | 5000.0 nM | |
| 1249963 | 90 | 80 | 38 | 24 | 1.00 |
| 1248359 | 79 | 52 | 33 | 18 | 0.46 |
| 1250015 | 92 | 87 | 52 | 48 | 3.22 |
| 1248718 | 89 | 71 | 41 | 34 | 1.16 |
| 1250146 | 77 | 50 | 28 | 20 | 0.40 |
| 1249418 | 76 | 45 | 25 | 12 | 0.32 |
| 1250198 | 115 | 76 | 42 | 24 | 1.19 |
| 1249444 | 141 | 77 | 36 | 13 | 1.08 |

TABLE 39

Dose-dependent reduction of human SCN2A RNA
in SH-SY5Y cells by modified oligonucleotides

| Compound ID | SCN2A RNA (% control) | | | | IC$_{50}$ (µM) |
|---|---|---|---|---|---|
| | 78.125 nM | 313.5 nM | 1250.0 nM | 5000.0 nM | |
| 910263 | 108 | 69 | 35 | 23 | 0.95 |
| 1249470 | 91 | 62 | 39 | 16 | 0.70 |
| 1248593 | 79 | 69 | 41 | 26 | 0.82 |
| 1249210 | 88 | 74 | 42 | 17 | 0.83 |
| 1249912 | 89 | 74 | 43 | 23 | 0.97 |
| 1248976 | 94 | 65 | 43 | 23 | 0.91 |
| 1249990 | 96 | 65 | 38 | 15 | 0.75 |
| 1249340 | 95 | 67 | 40 | 14 | 0.77 |
| 1248542 | 100 | 75 | 53 | 28 | 1.42 |
| 1249341 | 87 | 70 | 34 | 18 | 0.70 |
| 1249237 | 86 | 59 | 29 | 18 | 0.55 |
| 1249445 | 72 | 42 | 27 | 16 | 0.28 |
| 1248439 | 79 | 50 | 29 | 19 | 0.42 |
| 1249315 | 89 | 64 | 42 | 21 | 0.80 |
| 1250199 | 97 | 69 | 45 | 21 | 0.97 |
| 1250225 | 75 | 57 | 34 | 20 | 0.49 |
| 1249576 | 107 | 67 | 37 | 20 | 0.90 |
| 1249602 | 121 | 67 | 35 | 21 | 0.99 |
| 1250070 | 103 | 64 | 30 | 22 | 0.80 |

TABLE 40

Dose-dependent reduction of human SCN2A RNA
in SH-SY5Y cells by modified oligonucleotides

| Compound ID | SCN2A RNA (% control) | | | | IC$_{50}$ (µM) |
|---|---|---|---|---|---|
| | 78.125 nM | 313.5 nM | 1250.0 nM | 5000.0 nM | |
| 910263 | 102 | 61 | 33 | 22 | 0.80 |
| 1248466 | 105 | 53 | 32 | 10 | 0.62 |
| 1248414 | 88 | 69 | 32 | 9 | 0.60 |
| 1250148 | 89 | 60 | 34 | 11 | 0.57 |
| 1249316 | 82 | 67 | 35 | 15 | 0.61 |
| 1249160 | 83 | 66 | 35 | 15 | 0.61 |
| 909602 | 80 | 54 | 34 | 27 | 0.56 |
| 1248543 | 79 | 60 | 33 | 21 | 0.55 |
| 1248440 | 83 | 60 | 32 | 21 | 0.59 |
| 1250226 | 109 | 78 | 47 | 21 | 1.20 |
| 1249863 | 85 | 61 | 29 | 9 | 0.50 |
| 1249811 | 92 | 67 | 38 | 21 | 0.81 |
| 1249161 | 85 | 60 | 42 | 21 | 0.72 |
| 1250227 | 88 | 70 | 38 | 19 | 0.78 |
| 1248441 | 78 | 60 | 27 | 16 | 0.45 |
| 1250149 | 84 | 61 | 31 | 16 | 0.56 |
| 1248363 | 89 | 73 | 32 | 24 | 0.80 |

TABLE 40-continued

Dose-dependent reduction of human SCN2A RNA
in SH-SY5Y cells by modified oligonucleotides

| Compound ID | SCN2A RNA (% control) | | | | IC$_{50}$ (µM) |
|---|---|---|---|---|---|
| | 78.125 nM | 313.5 nM | 1250.0 nM | 5000.0 nM | |
| 1249759 | 124 | 71 | 34 | 16 | 0.96 |
| 1249291 | 126 | 80 | 50 | 22 | 1.38 |

TABLE 41

Dose-dependent reduction of human SCN2A RNA
in SH-SY5Y cells by modified oligonucleotides

| Compound ID | SCN2A RNA (% control) | | | | IC$_{50}$ (µM) |
|---|---|---|---|---|---|
| | 78.125 nM | 313.5 nM | 1250.0 nM | 5000.0 nM | |
| 910263 | 91 | 57 | 27 | 12 | 0.53 |
| 1249187 | 102 | 78 | 49 | 19 | 1.15 |
| 1248519 | 91 | 73 | 44 | 20 | 0.94 |
| 1249448 | 91 | 71 | 37 | 30 | 0.99 |
| 1249266 | 80 | 56 | 28 | 13 | 0.44 |
| 1249344 | 87 | 58 | 27 | 24 | 0.59 |
| 1249370 | 79 | 67 | 40 | 24 | 0.75 |
| 1249890 | 80 | 69 | 36 | 21 | 0.69 |
| 1250021 | 84 | 48 | 25 | 10 | 0.39 |
| 1249371 | 91 | 77 | 59 | 20 | 1.27 |
| 1249527 | 89 | 82 | 47 | 17 | 1.02 |
| 1249163 | 102 | 90 | 61 | 28 | 1.89 |
| 1249995 | 85 | 61 | 31 | 18 | 0.58 |
| 1249267 | 86 | 59 | 36 | 21 | 0.65 |
| 1249164 | 43 | 32 | 13 | 7 | <0.1 |
| 1248366 | 67 | 48 | 23 | 10 | 0.25 |
| 1249294 | 80 | 53 | 22 | 13 | 0.39 |
| 1249788 | 111 | 61 | 46 | 15 | 0.91 |
| 1249710 | 97 | 61 | 47 | 14 | 0.80 |

TABLE 42

Dose-dependent reduction of human SCN2A RNA
in SH-SY5Y cells by modified oligonucleotides

| Compound ID | SCN2A RNA (% control) | | | | IC$_{50}$ (µM) |
|---|---|---|---|---|---|
| | 78.125 nM | 313.5 nM | 1250.0 nM | 5000.0 nM | |
| 910263 | 85 | 58 | 26 | 19 | 0.52 |
| 1249216 | 99 | 78 | 43 | 13 | 0.93 |
| 1249528 | 95 | 89 | 56 | 22 | 1.45 |
| 1249632 | 80 | 82 | 39 | 18 | 0.85 |
| 1250204 | 77 | 70 | 39 | 18 | 0.67 |
| 1248522 | 110 | 71 | 43 | 14 | 0.95 |
| 1249554 | 87 | 71 | 41 | 24 | 0.91 |
| 1249580 | 73 | 61 | 40 | 20 | 0.55 |
| 1248368 | 81 | 61 | 23 | 10 | 0.44 |
| 1249296 | 88 | 47 | 21 | 9 | 0.39 |
| 1248394 | 89 | 72 | 33 | 13 | 0.68 |
| 1249842 | 97 | 85 | 48 | 23 | 1.28 |
| 1248524 | 79 | 55 | 36 | 25 | 0.57 |
| 1248446 | 90 | 60 | 30 | 24 | 0.67 |
| 1249452 | 100 | 60 | 29 | 26 | 0.78 |
| 1250050 | 87 | 54 | 34 | 20 | 0.58 |
| 1249920 | 81 | 54 | 24 | 19 | 0.44 |
| 1249712 | 140 | 72 | 37 | 18 | 1.12 |
| 1249868 | 92 | 58 | 32 | 17 | 0.62 |

TABLE 43

Dose-dependent reduction of human SCN2A RNA in SH-SY5Y cells by modified oligonucleotides

| Compound ID | SCN2A RNA (% control) | | | | IC$_{50}$ (µM) |
| --- | --- | --- | --- | --- | --- |
| | 78.125 nM | 313.5 nM | 1250.0 nM | 5000.0 nM | |
| 910263 | 96 | 52 | 36 | 24 | 0.70 |
| 1249998 | 97 | 86 | 66 | 45 | 3.89 |
| 1248447 | 88 | 63 | 48 | 25 | 0.96 |
| 1249297 | 84 | 49 | 41 | 13 | 0.51 |
| 1249167 | 82 | 59 | 30 | 11 | 0.48 |
| 1248369 | 90 | 50 | 34 | 25 | 0.61 |
| 1249713 | N.D. | 54 | 33 | 10 | 1.98 |
| 1249401 | 67 | 57 | 37 | 27 | 0.47 |
| 1249349 | 91 | 83 | 57 | 35 | 2.02 |
| 1248395 | 97 | 66 | 36 | 25 | 0.87 |
| 1249427 | 86 | 67 | 51 | 24 | 1.01 |
| 1249869 | 111 | 103 | 61 | 36 | 2.63 |
| 1249685 | 72 | 51 | 33 | 17 | 0.38 |
| 1249711 | 97 | 64 | 51 | 27 | 1.15 |
| 1248445 | 77 | 62 | 41 | 31 | 0.81 |
| 1249633 | 71 | 50 | 35 | 16 | 0.36 |
| 1248523 | 95 | 71 | 40 | 21 | 0.91 |
| 1249893 | 137 | 83 | 50 | 37 | 1.93 |
| 1249659 | 90 | 56 | 33 | 13 | 0.57 |

TABLE 44

Dose-dependent reduction of human SCN2A RNA in SH-SY5Y cells by modified oligonucleotides

| Compound ID | SCN2A RNA (% control) | | | | IC$_{50}$ (µM) |
| --- | --- | --- | --- | --- | --- |
| | 78.125 nM | 313.5 nM | 1250.0 nM | 5000.0 nM | |
| 910263 | 126 | 68 | 29 | 31 | 1.11 |
| 1249997 | 98 | 85 | 53 | 37 | 2.01 |
| 1249867 | 88 | 63 | 31 | 18 | 0.63 |
| 1249529 | 102 | 81 | 51 | 25 | 1.37 |
| 1249217 | 103 | 87 | 54 | 23 | 1.46 |
| 1249295 | 76 | 49 | 25 | 18 | 0.36 |
| 1249269 | 98 | 58 | 31 | 12 | 0.62 |
| 1248396 | 90 | 67 | 23 | 15 | 0.59 |
| 1249428 | 87 | 51 | 32 | 15 | 0.50 |
| 1249298 | 61 | 49 | 29 | 11 | 0.23 |
| 1249792 | 92 | 53 | 47 | 21 | 0.78 |
| 1249402 | 102 | 79 | 50 | 41 | 2.00 |
| 1248370 | 98 | 65 | 25 | 17 | 0.67 |
| 1248526 | 72 | 45 | 31 | 15 | 0.31 |
| 1249272 | 73 | 63 | 35 | 14 | 0.48 |
| 1250234 | 103 | 60 | 38 | 18 | 0.80 |
| 1249273 | 80 | 36 | 17 | 13 | 0.27 |
| 1250235 | 90 | 39 | 24 | 14 | 0.40 |
| 1248371 | 95 | 40 | 28 | 17 | 0.47 |

TABLE 45

Dose-dependent reduction of human SCN2A RNA in SH-SY5Y cells by modified oligonucleotides

| Compound ID | SCN2A RNA (% control) | | | | IC$_{50}$ (µM) |
| --- | --- | --- | --- | --- | --- |
| | 78.125 nM | 313.5 nM | 1250.0 nM | 5000.0 nM | |
| 910263 | 127 | 79 | 30 | 16 | 1.01 |
| 1249403 | 85 | 47 | 30 | 17 | 0.45 |
| 1249377 | 76 | 60 | 37 | 16 | 0.51 |
| 1249169 | 89 | 63 | 32 | 20 | 0.66 |
| 1248475 | 96 | 76 | 44 | 19 | 1.01 |
| 1249429 | 105 | 80 | 54 | 30 | 1.60 |

TABLE 45-continued

Dose-dependent reduction of human SCN2A RNA
in SH-SY5Y cells by modified oligonucleotides

| Compound ID | SCN2A RNA (% control) | | | | IC$_{50}$ (μM) |
|---|---|---|---|---|---|
| | 78.125 nM | 313.5 nM | 1250.0 nM | 5000.0 nM | |
| 1249222 | 81 | 42 | 22 | 10 | 0.32 |
| 1249274 | 76 | 50 | 26 | 13 | 0.35 |
| 1249170 | 77 | 51 | 31 | 9 | 0.38 |
| 1248476 | 81 | 67 | 36 | 15 | 0.62 |
| 1248398 | 91 | 58 | 33 | 22 | 0.66 |
| 1250236 | 94 | 77 | 44 | 22 | 1.04 |
| 1249196 | 113 | 83 | 41 | 25 | 1.27 |
| 1249482 | 87 | 51 | 43 | 23 | 0.66 |
| 1248372 | 64 | 54 | 30 | 17 | 0.30 |
| 1250184 | 69 | 72 | 24 | 21 | 0.49 |
| 1249483 | 76 | 52 | 24 | 23 | 0.39 |
| 1249639 | 107 | 60 | 34 | 11 | 0.71 |
| 1248425 | 85 | 56 | 32 | 17 | 0.53 |

TABLE 46

Dose-dependent reduction of human SCN2A RNA
in SH-SY5Y cells by modified oligonucleotides

| Compound ID | SCN2A RNA (% control) | | | | IC$_{50}$ (μM) |
|---|---|---|---|---|---|
| | 78.125 nM | 313.5 nM | 1250.0 nM | 5000.0 nM | |
| 910263 | 112 | 79 | 32 | 9 | 0.86 |
| 1250081 | 75 | 78 | 45 | 12 | 0.73 |
| 1249171 | 84 | 70 | 35 | 17 | 0.68 |
| 1249223 | 84 | 88 | 57 | 25 | 1.56 |
| 1249613 | 82 | 57 | 31 | 12 | 0.47 |
| 1248399 | 89 | 75 | 48 | 19 | 0.98 |
| 1249873 | 80 | 63 | 37 | 25 | 0.68 |
| 1249484 | 66 | 40 | 20 | 13 | 0.19 |
| 1249328 | 79 | 72 | 33 | 17 | 0.63 |
| 1250238 | 80 | 51 | 27 | 12 | 0.40 |
| 1249588 | 55 | 43 | 14 | 5 | 0.13 |
| 1249406 | 77 | 63 | 26 | 13 | 0.46 |
| 1249822 | 84 | 67 | 33 | 14 | 0.60 |
| 1249536 | 78 | 71 | 37 | 18 | 0.66 |
| 1248400 | 71 | 54 | 22 | 17 | 0.33 |
| 1249485 | 46 | 20 | 9 | 7 | <0.1 |
| 1249953 | 73 | 39 | 12 | 8 | 0.21 |
| 1249251 | 106 | 69 | 29 | 13 | 0.76 |
| 1250161 | 100 | 62 | 27 | 13 | 0.65 |

TABLE 47

Dose-dependent reduction of human SCN2A RNA
in SH-SY5Y cells by modified oligonucleotides

| Compound ID | SCN2A RNA (% control) | | | | IC$_{50}$ (μM) |
|---|---|---|---|---|---|
| | 78.125 nM | 313.5 nM | 1250.0 nM | 5000.0 nM | |
| 910263 | 93 | 55 | 22 | 9 | 0.48 |
| 1249225 | 64 | 43 | 23 | 8 | 0.20 |
| 1248479 | 60 | 48 | 21 | 11 | 0.19 |
| 1249589 | 91 | 57 | 24 | 8 | 0.50 |
| 1250005 | 80 | 73 | 38 | 15 | 0.68 |
| 1250239 | 70 | 60 | 32 | 15 | 0.41 |
| 1248375 | 70 | 47 | 26 | 7 | 0.27 |
| 1248376 | 62 | 49 | 21 | 6 | 0.21 |
| 1248480 | 94 | 59 | 31 | 8 | 0.56 |
| 1250084 | 68 | 36 | 13 | 4 | 0.18 |
| 1249278 | 66 | 38 | 18 | 6 | 0.18 |
| 1249252 | 83 | 55 | 27 | 9 | 0.44 |

TABLE 47-continued

Dose-dependent reduction of human SCN2A RNA in SH-SY5Y cells by modified oligonucleotides

| Compound ID | SCN2A RNA (% control) | | | | IC$_{50}$ (μM) |
|---|---|---|---|---|---|
| | 78.125 nM | 313.5 nM | 1250.0 nM | 5000.0 nM | |
| 1249486 | 77 | 47 | 22 | 9 | 0.31 |
| 1248350 | 89 | 68 | 41 | 17 | 0.78 |
| 1250266 | 54 | 35 | 15 | 6 | 0.10 |
| 1250188 | 68 | 54 | 26 | 5 | 0.29 |
| 1249304 | 88 | 96 | 23 | 7 | 0.73 |
| 1249330 | 102 | 67 | 38 | 18 | 0.85 |
| 1249772 | 107 | 67 | 39 | 16 | 0.87 |

TABLE 48

Dose-dependent reduction of human SCN2A RNA in SH-SY5Y cells by modified oligonucleotides

| Compound ID | SCN2A RNA (% control) | | | | IC$_{50}$ (μM) |
|---|---|---|---|---|---|
| | 78.125 nM | 313.5 nM | 1250.0 nM | 5000.0 nM | |
| 910263 | 83 | 53 | 31 | 19 | 0.49 |
| 1248532 | 93 | 94 | 56 | 23 | 1.59 |
| 1249642 | 108 | 62 | 31 | 17 | 0.76 |
| 1249408 | 91 | 68 | 31 | 15 | 0.66 |
| 1249590 | 106 | 72 | 30 | 22 | 0.90 |
| 1249226 | 110 | 63 | 36 | 14 | 0.80 |
| 1248429 | 77 | 58 | 26 | 21 | 0.46 |
| 1249305 | 55 | 41 | 18 | 10 | 0.12 |
| 1248377 | 96 | 71 | 35 | 16 | 0.79 |
| 1248533 | 98 | 64 | 42 | 14 | 0.79 |
| 1249539 | 75 | 66 | 48 | 19 | 0.72 |
| 1248481 | 77 | 58 | 26 | 15 | 0.42 |
| 1248534 | 91 | 64 | 34 | 15 | 0.66 |
| 1249306 | 83 | 59 | 23 | 11 | 0.45 |
| 1249930 | 82 | 48 | 28 | 11 | 0.39 |
| 1249800 | 62 | 27 | 16 | 8 | 0.11 |
| 1248404 | 106 | 86 | 47 | 23 | 1.31 |
| 1248482 | 122 | 44 | 29 | 9 | 0.65 |
| 1250138 | 105 | 63 | 28 | 27 | 0.84 |

TABLE 49

Dose-dependent reduction of human SCN2A RNA in SH-SY5Y cells by modified oligonucleotides

| Compound ID | SCN2A RNA (% control) | | | | IC$_{50}$ (μM) |
|---|---|---|---|---|---|
| | 78.125 nM | 313.5 nM | 1250.0 nM | 5000.0 nM | |
| 910263 | 99 | 61 | 45 | 22 | 0.92 |
| 1248430 | 90 | 63 | 39 | 9 | 0.63 |
| 1249852 | 93 | 80 | 48 | 33 | 1.52 |
| 1250164 | 69 | 61 | 39 | 16 | 0.48 |
| 1250034 | 115 | 99 | 61 | 51 | >5.0 |
| 1248352 | 96 | 79 | 54 | 39 | 2.09 |
| 1249462 | 88 | 86 | 50 | 43 | 2.48 |
| 1248585 | 75 | 55 | 40 | 29 | 0.60 |
| 1249722 | 115 | 86 | 57 | 23 | 1.57 |
| 1249956 | 72 | 97 | 58 | 31 | 2.17 |
| 1250060 | 76 | 82 | 63 | 30 | 1.90 |
| 1248353 | 82 | 62 | 39 | 29 | 0.81 |
| 1248612 | 95 | 76 | 55 | 38 | 1.96 |
| 1249515 | 94 | 69 | 48 | 24 | 1.06 |
| 1249983 | 70 | 65 | 52 | 31 | 1.04 |
| 1248431 | 85 | 77 | 51 | 20 | 1.04 |
| 1248535 | 103 | 88 | 73 | 47 | >5.0 |

TABLE 49-continued

Dose-dependent reduction of human SCN2A RNA in SH-SY5Y cells by modified oligonucleotides

| Compound ID | SCN2A RNA (% control) | | | | IC$_{50}$ ($\mu$M) |
|---|---|---|---|---|---|
| | 78.125 nM | 313.5 nM | 1250.0 nM | 5000.0 nM | |
| 1249437 | 139 | 72 | 56 | 32 | 1.73 |
| 1249671 | 99 | 59 | 48 | 24 | 0.95 |

TABLE 50

Dose-dependent reduction of human SCN2A RNA in SH-SY5Y cells by modified oligonucleotides

| Compound ID | SCN2A RNA (% control) | | | | IC$_{50}$ ($\mu$M) |
|---|---|---|---|---|---|
| | 78.125 nM | 313.5 nM | 1250.0 nM | 5000.0 nM | |
| 910263 | 98 | 55 | 30 | 16 | 0.62 |
| 1250165 | 103 | 76 | 63 | 30 | 1.81 |
| 1248483 | 70 | 48 | 31 | 14 | 0.32 |
| 1249801 | 90 | 73 | 33 | 21 | 0.79 |
| 1249749 | 61 | 71 | 58 | 27 | 1.05 |
| 1248510 | 55 | 33 | 25 | 7 | 0.10 |
| 1249802 | 56 | 35 | 21 | 8 | 0.11 |
| 1248354 | 74 | 53 | 21 | 15 | 0.34 |
| 1250010 | 89 | 64 | 45 | 27 | 0.96 |
| 1250114 | 92 | 86 | 48 | 16 | 1.07 |
| 1249438 | 79 | 67 | 28 | 18 | 0.56 |
| 1249854 | 97 | 62 | 41 | 46 | 1.56 |
| 1248484 | 57 | 39 | 22 | 9 | 0.13 |
| 1249204 | 66 | 47 | 22 | 12 | 0.24 |
| 1249282 | 74 | 52 | 28 | 15 | 0.36 |
| 1249906 | 75 | 73 | 52 | 21 | 0.93 |
| 1248406 | 97 | 91 | 53 | 26 | 1.56 |
| 1249646 | 145 | 88 | 48 | 39 | 2.02 |
| 910263 | 114 | 81 | 35 | 27 | 1.17 |

Example 3: Design of MOE Gapmer Modified Oligonucleotides Complementary to Human SCN2A Nucleic Acid Modified oligonucleotides complementary to a human SCN2A nucleic acid were designed, as described in the tables below. "Start site" in the tables below indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the tables below is 100% complementary to SEQ ID NO: 1. (GENBANK Accession No. NM_001040142.2) or SEQ ID NO: 2 (GENBANK Accession No. NC_000002.12 truncated from nucleotides 165127001 to 165395000), or to both. 'N/A' indicates that the modified oligonucleotide is not 100% complementary to that particular target nucleic acid sequence.

The modified oligonucleotides in Table 51 are 5-10-5 MOE gapmers. The gapmers are 20 nucleosides in length, wherein the central gap segment consists of ten 2'-β-D-deoxynucleosides and the 5' and 3' wing segments each consists of five 2'-MOE nucleosides. The sugar motif for the gapmers is (from 5' to 3'): eeeeedddddddddeeeee; wherein 'd' represents a 2'-β-D-deoxyribosyl sugar moiety, and 'e' represents a 2'-MOE sugar moiety. The gapmers have an internucleoside linkage motif of (from 5 to 3'): soooosssssssssooss; wherein each represents a phosphorothioate internucleoside linkage and each "o" represents a phosphodiester internucleoside linkage. Each cytosine residue is a 5-methyl cytosine.

TABLE 51

5-10-5 MOE gapmers with mixed PO/PS internucleoside linkages complementary to human SCN2A

| Compound ID | SEQUENCE (5' to 3') | SEQ ID NO: 1 Start Site | SEQ ID NO: 1 Stop Site | SEQ ID NO: 2 Start Site | SEQ ID NO: 2 Stop Site | SEQ ID NO. |
|---|---|---|---|---|---|---|
| 1348240 | GACCGAATTCTATTTTATAA | N/A | N/A | 229460 | 229479 | 2477 |
| 1348241 | ACCGAATTCTATTTTATAAA | N/A | N/A | 229459 | 229478 | 2478 |
| 1348242 | CCGAATTCTATTTTATAAAT | N/A | N/A | 229458 | 229477 | 2479 |

TABLE 51-continued 5-10-5 MOE gapmers with mixed PO/PS internucleoside
linkages complementary to human SCN2A

| Compound ID | SEQUENCE (5' to 3') | SEQ ID NO: 1 Start Site | SEQ ID NO: 1 Stop Site | SEQ ID NO: 2 Start Site | SEQ ID NO: 2 Stop Site | SEQ ID NO. |
|---|---|---|---|---|---|---|
| 1348243 | CGAATTCTATTTTATAAATG | N/A | N/A | 229457 | 229476 | 2480 |
| 1348244 | GAATTCTATTTTATAAATGC | N/A | N/A | 229456 | 229475 | 2481 |
| 1348245 | AATTCTATTTTATAAATGCC | N/A | N/A | 229455 | 229474 | 2482 |
| 1348248 | ATGTAACCTTTATACATTTA | N/A | N/A | 243913 | 243932 | 2483 |
| 1348250 | ATTCTGCATGTAACCTTTAT | N/A | N/A | 243920 | 243939 | 2484 |
| 1348251 | TTCTGCATGTAACCTTTATA | N/A | N/A | 243919 | 243938 | 2485 |
| 1348252 | TGCATGTAACCTTTATACAT | N/A | N/A | 243916 | 243935 | 2486 |
| 1348253 | TCTGCATGTAACCTTTATAC | N/A | N/A | 243918 | 243937 | 2487 |
| 1348254 | CATGTAACCTTTATACATTT | N/A | N/A | 243914 | 243933 | 2488 |
| 1348255 | GCATGTAACCTTTATACATT | N/A | N/A | 243915 | 243934 | 2489 |
| 1348256 | TGTAACCTTTATACATTTAA | N/A | N/A | 243912 | 243931 | 2490 |
| 1348257 | GTAACCTTTATACATTTAAT | N/A | N/A | 243911 | 243930 | 2491 |
| 1348258 | CCAGTTTTTTCATTGCATCC | N/A | N/A | 255533 | 255552 | 2492 |
| 1348259 | GCATAATCCCATTATACAAA | N/A | N/A | 244051 | 244070 | 2493 |
| 1348263 | ATCATGCATAATCCCATTAT | N/A | N/A | 244056 | 244075 | 2494 |
| 1348264 | TCATGCATAATCCCATTATA | N/A | N/A | 244055 | 244074 | 2495 |
| 1348265 | CATAATCCCATTATACAAAT | N/A | N/A | 244050 | 244069 | 2496 |
| 1348266 | TGCATAATCCCATTATACAA | N/A | N/A | 244052 | 244071 | 2497 |
| 1348267 | CATGCATAATCCCATTATAC | N/A | N/A | 244054 | 244073 | 2498 |
| 1348328 | TCTTTCTTATTTCTGTTTCA | 2306 | 2325 | 199863 | 199882 | 2499 |
| 1348343 | CTCTTTCTTATTTCTGTTTC | 2307 | 2326 | 199864 | 199883 | 2500 |
| 1348378 | TGGACCGTCTCTTTCTTATT | 2315 | 2334 | 199872 | 199891 | 2501 |
| 1348380 | CTGGACCGTCTCTTTCTTAT | 2316 | 2335 | 199873 | 199892 | 2502 |
| 1348396 | CACGCTTACATCAAACATCT | 4396 | 4415 | 247830 | 247849 | 2503 |
| 1348405 | TATTTTCTACACTGCTGCC | 3513 | 3532 | 227507 | 227526 | 2504 |
| 1348411 | ATATTTTCTACACTGCTGC | 3514 | 3533 | 227508 | 227527 | 2505 |
| 1348423 | CATATTTTCTACACTGCTG | 3515 | 3534 | 227509 | 227528 | 2506 |
| 1348439 | ATGTAATCACTTTCATCCAC | 3537 | 3556 | 227531 | 227550 | 2507 |
| 1348440 | AATCACTTTCATCCACGACA | 3533 | 3552 | 227527 | 227546 | 2508 |
| 1348441 | TAATCACTTTCATCCACGAC | 3534 | 3553 | 227528 | 227547 | 2509 |
| 1348442 | CCACGACATATTTTCTACA | 3521 | 3540 | 227515 | 227534 | 2510 |
| 1348443 | ATCACTTTCATCCACGACAT | 3532 | 3551 | 227526 | 227545 | 2511 |
| 1348444 | ACGACATATTTTCTACACT | 3519 | 3538 | 227513 | 227532 | 2512 |
| 1348446 | TCCACGACATATTTTCTAC | 3522 | 3541 | 227516 | 227535 | 2513 |
| 1348447 | CACGACATATTTTCTACAC | 3520 | 3539 | 227514 | 227533 | 2514 |
| 1348448 | GCATGTTTATCTTAGTTCTA | N/A | N/A | 224196 | 224215 | 2515 |

TABLE 51-continued 5-10-5 MOE gapmers with mixed PO/PS internucleoside linkages complementary to human SCN2A

| Compound ID | SEQUENCE (5' to 3') | SEQ ID NO: 1 Start Site | SEQ ID NO: 1 Stop Site | SEQ ID NO: 2 Start Site | SEQ ID NO: 2 Stop Site | SEQ ID NO. |
|---|---|---|---|---|---|---|
| 1348449 | CCATTTCTATAACTCAGCAA | N/A | N/A | 180685 | 180704 | 2516 |
| 1348450 | TTGACCACGCTTACATCAAA | 4401 | 4420 | 247835 | 247854 | 2517 |
| 1348451 | AGCATGTTTATCTTAGTTCT | N/A | N/A | 224197 | 224216 | 2518 |
| 1348453 | CATTTCTATAACTCAGCAAC | N/A | N/A | 180684 | 180703 | 2519 |
| 1348455 | ATTTCTATAACTCAGCAACC | N/A | N/A | 180683 | 180702 | 2520 |
| 1348456 | CATGTAATCACTTTCATCCA | 3538 | 3557 | 227532 | 227551 | 2521 |

The modified oligonucleotides M Table 52 below are 6-10-4 MOE gapmers. The gapmers are 20 nucleosides in length, wherein the central gap segment consists of ten 2'-β-D-deoxynucleosides, the 5' wing segment consists of six MOE nucleosides, and the 3 wing segment consists of four 2'-MOE nucleosides. The sugar motif for the gapmers is (from 5' to 3'): eeeeeedddddddddeeee, wherein 'd' represents a 2'D-deoxyribosyl sugar moiety, and 'e' represents a 2'-MOE sugar moiety. The gapmers have an internucleoside linkage motif of (from 5' to 3): sooooosssssssssoss; wherein each "s" represents a phosphorothioate internucleoside linkage and each "o" represents a phosphodiester internucleoside linkage. Each cytosine residue is a 5-methyl cytosine.

TABLE 52

6-10-4 MOE gapmers with mixed PO/PS internucleoside linkages complementary to human SCN2A

| Compound ID | SEQUENCE (5' to 3') | SEQ ID NO: 1 Start Site | SEQ ID NO: 1 Stop Site | SEQ ID NO: 2 Start Site | SEQ ID NO: 2 Stop Site | SEQ ID NO. |
|---|---|---|---|---|---|---|
| 1348269 | CACGCTTACATCAAACATCT | 4396 | 4415 | 247830 | 247849 | 2503 |
| 1348270 | TGACCACGCTTACATCAAAC | 4400 | 4419 | 247834 | 247853 | 2522 |
| 1348271 | GACCACGCTTACATCAAACA | 4399 | 4418 | 247833 | 247852 | 29 |
| 1348275 | ACCACGCTTACATCAAACAT | 4398 | 4417 | 247832 | 247851 | 2025 |
| 1348277 | CCACGCTTACATCAAACATC | 4397 | 4416 | 247831 | 247850 | 419 |
| 1348279 | GACCGTCTCTTTCTTATTTC | 2313 | 2332 | 199870 | 199889 | 2326 |
| 1348282 | CTCTTTCTTATTTCTGTTTC | 2307 | 2326 | 199864 | 199883 | 2500 |
| 1348286 | GTCTCTTTCTTATTTCTGTT | 2309 | 2328 | 199866 | 199885 | 2097 |
| 1348289 | CACGACATATTTTCTACAC | 3520 | 3539 | 227514 | 227533 | 2514 |
| 1348290 | CCACGACATATTTTCTACA | 3521 | 3540 | 227515 | 227534 | 2510 |
| 1348291 | ACGACATATTTTCTACACT | 3519 | 3538 | 227513 | 227532 | 2512 |
| 1348292 | ACATATTTTCTACACTGCT | 3516 | 3535 | 227510 | 227529 | 643 |
| 1348295 | ATATTTTCTACACTGCTGC | 3514 | 3533 | 227508 | 227527 | 2505 |
| 1348297 | TGGACCGTCTCTTTCTTATT | 2315 | 2334 | 199872 | 199891 | 2501 |
| 1348298 | AATCACTTTCATCCACGACA | 3533 | 3552 | 227527 | 227546 | 2508 |
| 1348299 | CAGCATATTCTAACATGGTC | 3995 | 4014 | 243167 | 243186 | 491 |
| 1348300 | ATTTCTATAACTCAGCAACC | N/A | N/A | 180683 | 180702 | 2520 |
| 1348302 | ATGTAATCACTTTCATCCAC | 3537 | 3556 | 227531 | 227550 | 2507 |
| 1348303 | CATGTAATCACTTTCATCCA | 3538 | 3557 | 227532 | 227551 | 2521 |
| 1348304 | TCCACGACATATTTTCTAC | 3522 | 3541 | 227516 | 227535 | 2513 |

TABLE 52-continued 6-10-4 MOE gapmers with mixed PO/PS internucleoside linkages complementary to human SCN2A

| Compound ID | SEQUENCE (5' to 3') | SEQ ID NO: 1 Start Site | SEQ ID NO: 1 Stop Site | SEQ ID NO: 2 Start Site | SEQ ID NO: 2 Stop Site | SEQ ID NO. |
|---|---|---|---|---|---|---|
| 1348306 | TAATCACTTTCATCCACGAC | 3534 | 3553 | 227528 | 227547 | 2509 |
| 1348307 | ATCACTTTCATCCACGACAT | 3532 | 3551 | 227526 | 227545 | 2511 |
| 1348308 | CCATTTCTATAACTCAGCAA | N/A | N/A | 180685 | 180704 | 2516 |
| 1348309 | TCAGCATGTTTATCTTAGTT | N/A | N/A | 224199 | 224218 | 2523 |
| 1348310 | CAGCATGTTTATCTTAGTTC | N/A | N/A | 224198 | 224217 | 2079 |
| 1348311 | AGCATGTTTATCTTAGTTCT | N/A | N/A | 224197 | 224216 | 2518 |
| 1348312 | GCATGTTTATCTTAGTTCTA | N/A | N/A | 224196 | 224215 | 2515 |
| 1348313 | TGCCATTTCTATAACTCAGC | N/A | N/A | 180687 | 180706 | 2524 |
| 1348315 | CATTTCTATAACTCAGCAAC | N/A | N/A | 180684 | 180703 | 2519 |
| 1348316 | TTTGCCATTTCTATAACTCA | N/A | N/A | 180689 | 180708 | 909 |
| 1348319 | GTAACCTTTATACATTTAAT | N/A | N/A | 243911 | 243930 | 2491 |
| 1348320 | GACCGAATTCTATTTTATAA | N/A | N/A | 229460 | 229479 | 2477 |
| 1348321 | CCGAATTCTATTTTATAAAT | N/A | N/A | 229458 | 229477 | 2479 |
| 1348322 | ACCGAATTCTATTTTATAAA | N/A | N/A | 229459 | 229478 | 2478 |
| 1348323 | GAATTCTATTTTATAAATGC | N/A | N/A | 229456 | 229475 | 2481 |
| 1348324 | CGAATTCTATTTTATAAATG | N/A | N/A | 229457 | 229476 | 2480 |
| 1348325 | AATTCTATTTTATAAATGCC | N/A | N/A | 229455 | 229474 | 2482 |
| 1348326 | TTCTATTTTATAAATGCCGA | N/A | N/A | 229453 | 229472 | 854 |
| 1348327 | ATTCTATTTTATAAATGCCG | N/A | N/A | 229454 | 229473 | 931 |
| 1348329 | GCATGTAACCTTTATACATT | N/A | N/A | 243915 | 243934 | 2489 |
| 1348331 | TCTGCATGTAACCTTTATAC | N/A | N/A | 243918 | 243937 | 2487 |
| 1348332 | TTCTGCATGTAACCTTTATA | N/A | N/A | 243919 | 243938 | 2485 |
| 1348333 | CTGCATGTAACCTTTATACA | N/A | N/A | 243917 | 243936 | 1090 |
| 1348334 | TGCATGTAACCTTTATACAT | N/A | N/A | 243916 | 243935 | 2486 |
| 1348335 | ATGTAACCTTTATACATTTA | N/A | N/A | 243913 | 243932 | 2483 |
| 1348336 | TGTAACCTTTATACATTTAA | N/A | N/A | 243912 | 243931 | 2490 |
| 1348337 | CATGTAACCTTTATACATTT | N/A | N/A | 243914 | 243933 | 2488 |
| 1348338 | TGCATAATCCCATTATACAA | N/A | N/A | 244052 | 244071 | 2497 |
| 1348340 | ATCATGCATAATCCCATTAT | N/A | N/A | 244056 | 244075 | 2494 |
| 1348341 | TCATGCATAATCCCATTATA | N/A | N/A | 244055 | 244074 | 2495 |
| 1348342 | CATGCATAATCCCATTATAC | N/A | N/A | 244054 | 244073 | 2498 |
| 1348344 | ATGCATAATCCCATTATACA | N/A | N/A | 244053 | 244072 | 1166 |
| 1348345 | CATAATCCCATTATACAAAT | N/A | N/A | 244050 | 244069 | 2496 |
| 1348347 | GCATAATCCCATTATACAAA | N/A | N/A | 244051 | 244070 | 2493 |

The modified oligonucleotides in Table 53 below are 4-10-6 MOE gapmers. The gapmers are 20 nucleosides in length, wherein the central gap segment consists of ten 2'-β-D-deoxynucleosides, the 5' wing segment consists of four 2'-MOE nucleosides, and the 3' wing segment consists of six 2-MOE nucleosides. The sugar motif for the gapmer is (from 5' to 3'): eeeedddddddddddeeeeee; wherein 'd' represents a 2'-β-D-deoxyribosyl sugar moiety, and 'e' represents a 2'-MOE sugar moiety. The gapmers have an internucleoside linkage motif of (from 5' to 31' sooossssssssssoooss; wherein each "s" represents a phosphorothioate internucleoside linkage and each "o" represents a phosphodiester internucleoside linkage. Each cytosine residue is a 5-methyl cytosine:

TABLE 53

4-10-6 MOE gapmers with mixed PO/PS internucleoside linkages complementary to human SCN2A

| Compound ID | SEQUENCE (5' to 3') | SEQ ID NO: 1 Start Site | SEQ ID NO: 1 Stop Site | SEQ ID NO: 2 Start Site | SEQ ID NO: 2 Stop Site | SEQ ID NO. |
|---|---|---|---|---|---|---|
| 1348348 | CACGCTTACATCAAACATCT | 4396 | 4415 | 247830 | 247849 | 2503 |
| 1348350 | TTTGGGCCATTTTCATCATC | 411 | 430 | 168956 | 168975 | 2525 |
| 1348353 | GACCACGCTTACATCAAACA | 4399 | 4418 | 247833 | 247852 | 29 |
| 1348355 | CCACGCTTACATCAAACATC | 4397 | 4416 | 247831 | 247850 | 419 |
| 1348356 | ACCACGCTTACATCAAACAT | 4398 | 4417 | 247832 | 247851 | 2025 |
| 1348358 | TCTCTTTCTTATTTCTGTTT | 2308 | 2327 | 199865 | 199884 | 2021 |
| 1348360 | GGACCGTCTCTTTCTTATTT | 2314 | 2333 | 199871 | 199890 | 2526 |
| 1348361 | CTGGACCGTCTCTTTCTTAT | 2316 | 2335 | 199873 | 199892 | 2502 |
| 1348362 | GACCGTCTCTTTCTTATTTC | 2313 | 2332 | 199870 | 199889 | 2326 |
| 1348364 | CGTCTCTTTCTTATTTCTGT | 2310 | 2329 | 199867 | 199886 | 2174 |
| 1348365 | CTCTTTCTTATTTCTGTTTC | 2307 | 2326 | 199864 | 199883 | 2500 |
| 1348366 | TCTTTCTTATTTCTGTTTCA | 2306 | 2325 | 199863 | 199882 | 2499 |
| 1348367 | GTCTCTTTCTTATTTCTGTT | 2309 | 2328 | 199866 | 199885 | 2097 |
| 1348369 | CCACGACATATTTTTCTACA | 3521 | 3540 | 227515 | 227534 | 2510 |
| 1348370 | CACGACATATTTTTCTACAC | 3520 | 3539 | 227514 | 227533 | 2514 |
| 1348371 | ACGACATATTTTTCTACACT | 3519 | 3538 | 227513 | 227532 | 2512 |
| 1348373 | GACATATTTTTCTACACTGC | 3517 | 3536 | 227511 | 227530 | 720 |
| 1348374 | CATATTTTTCTACACTGCTG | 3515 | 3534 | 227509 | 227528 | 2506 |
| 1348375 | TATTTTTCTACACTGCTGCC | 3513 | 3532 | 227507 | 227526 | 2504 |
| 1348376 | ACATATTTTTCTACACTGCT | 3516 | 3535 | 227510 | 227529 | 643 |
| 1348377 | ATATTTTTCTACACTGCTGC | 3514 | 3533 | 227508 | 227527 | 2505 |
| 1348379 | GCATATTCTAACATGGTCTT | 3993 | 4012 | 243165 | 243184 | 2527 |
| 1348381 | TAATCACTTTCATCCACGAC | 3534 | 3553 | 227528 | 227547 | 2509 |
| 1348382 | CATGTAATCACTTTCATCCA | 3538 | 3557 | 227532 | 227551 | 2521 |
| 1348383 | GTAATCACTTTCATCCACGA | 3535 | 3554 | 227529 | 227548 | 796 |
| 1348384 | ATGTAATCACTTTCATCCAC | 3537 | 3556 | 227531 | 227550 | 2507 |
| 1348385 | ATCACTTTCATCCACGACAT | 3532 | 3551 | 227526 | 227545 | 2511 |
| 1348386 | AATCACTTTCATCCACGACA | 3533 | 3552 | 227527 | 227546 | 2508 |
| 1348387 | TCCACGACATATTTTTCTAC | 3522 | 3541 | 227516 | 227535 | 2513 |
| 1348388 | CAGCATATTCTAACATGGTC | 3995 | 4014 | 243167 | 243186 | 491 |
| 1348392 | CCATTTCTATAACTCAGCAA | N/A | N/A | 180685 | 180704 | 2516 |
| 1348393 | GCCATTTCTATAACTCAGCA | N/A | N/A | 180686 | 180705 | 832 |
| 1348394 | CATTTCTATAACTCAGCAAC | N/A | N/A | 180684 | 180703 | 2519 |
| 1348395 | ATTTCTATAACTCAGCAACC | N/A | N/A | 180683 | 180702 | 2520 |
| 1348397 | AGCATATTCTAACATGGTCT | 3994 | 4013 | 243166 | 243185 | 2406 |
| 1348399 | CAGCATGTTTATCTTAGTTC | N/A | N/A | 224198 | 224217 | 2079 |
| 1348403 | TCAGCATGTTTATCTTAGTT | N/A | N/A | 224199 | 224218 | 2523 |
| 1348404 | GCATGTTTATCTTAGTTCTA | N/A | N/A | 224196 | 224215 | 2515 |
| 1348406 | TATTTATAAATGCCGACTT | N/A | N/A | 229450 | 229469 | 2528 |
| 1348407 | AGCATGTTTATCTTAGTTCT | N/A | N/A | 224197 | 224216 | 2518 |

TABLE 53-continued 4-10-6 MOE gapmers with mixed PO/PS internucleoside linkages complementary to human SCN2A

| Compound ID | SEQUENCE (5' to 3') | SEQ ID NO: 1 Start Site | SEQ ID NO: 1 Stop Site | SEQ ID NO: 2 Start Site | SEQ ID NO: 2 Stop Site | SEQ ID NO. |
|---|---|---|---|---|---|---|
| 1348408 | CCGAATTCTATTTTATAAAT | N/A | N/A | 229458 | 229477 | 2479 |
| 1348410 | ATTCTATTTTATAAATGCCG | N/A | N/A | 229454 | 229473 | 931 |
| 1348412 | GTAACCTTTATACATTTAAT | N/A | N/A | 243911 | 243930 | 2491 |
| 1348413 | GACCGAATTCTATTTTATAA | N/A | N/A | 229460 | 229479 | 2477 |
| 1348414 | CGAATTCTATTTTATAAATG | N/A | N/A | 229457 | 229476 | 2480 |
| 1348415 | GAATTCTATTTTATAAATGC | N/A | N/A | 229456 | 229475 | 2481 |
| 1348416 | AATTCTATTTTATAAATGCC | N/A | N/A | 229455 | 229474 | 2482 |
| 1348417 | TTCTATTTTATAAATGCCGA | N/A | N/A | 229453 | 229472 | 854 |
| 1348418 | GCATGTAACCTTTATACATT | N/A | N/A | 243915 | 243934 | 2489 |
| 1348419 | CATAATCCCATTATACAAAT | N/A | N/A | 244050 | 244069 | 2496 |
| 1348420 | TTCTGCATGTAACCTTTATA | N/A | N/A | 243919 | 243938 | 2485 |
| 1348421 | TCTGCATGTAACCTTTATAC | N/A | N/A | 243918 | 243937 | 2487 |
| 1348422 | TGCATGTAACCTTTATACAT | N/A | N/A | 243916 | 243935 | 2486 |
| 1348424 | ATGTAACCTTTATACATTTA | N/A | N/A | 243913 | 243932 | 2483 |
| 1348425 | CATGTAACCTTTATACATTT | N/A | N/A | 243914 | 243933 | 2488 |
| 1348426 | TGTAACCTTTATACATTTAA | N/A | N/A | 243912 | 243931 | 2490 |
| 1348427 | CTGCATGTAACCTTTATACA | N/A | N/A | 243917 | 243936 | 1090 |
| 1348428 | GCATAATCCCATTATACAAA | N/A | N/A | 244051 | 244070 | 2493 |
| 1348429 | GTTTTTTCATTGCATCCTCC | N/A | N/A | 255530 | 255549 | 2529 |
| 1348430 | AGTTTTTCATTGCATCCTC | N/A | N/A | 255531 | 255550 | 2530 |
| 1348433 | ATCATGCATAATCCCATTAT | N/A | N/A | 244056 | 244075 | 2494 |
| 1348434 | TCATGCATAATCCCATTATA | N/A | N/A | 244055 | 244074 | 2495 |
| 1348435 | TGCATAATCCCATTATACAA | N/A | N/A | 244052 | 244071 | 2497 |
| 1348436 | ATGCATAATCCCATTATACA | N/A | N/A | 244053 | 244072 | 1166 |
| 1348437 | CATGCATAATCCCATTATAC | N/A | N/A | 244054 | 244073 | 2498 |
| 1348438 | CCAGTTTTTTCATTGCATCC | N/A | N/A | 255533 | 255552 | 2492 |
| 1348445 | CAGTTTTTCATTGCATCCT | N/A | N/A | 255532 | 255551 | 2531 |

The modified a oligonucleotides in Table 54 below are 4-8-6 MOE gapmers. The gapmers are 18 nucleosides in length, wherein the central gap segment consists of eight 2'-β-D-deoxynucleosides, the 5' wing segment consists of four 2'-MOE nucleosides, and the 3' wing segment consists of six 2'-MOE nucleosides. The sugar motif for the gapmers is (from 5' to 3'): eeeedddddddeeeeee; wherein 'd' represents a 2'-ß-D-deoxyribosyl sugar moiety, and 'e' represents a 2'-MOE sugar moiety. The gapmers have an internucleoside linkage motif of (from 5' to 3'): soosssssssssoooss; wherein each "s" represents a phosphorothioate internucleoside linkage and each "o" represents a phosphodiester internucleoside linkage. Each cytosine residue is a 5-methyl cytosine.

TABLE 54

4-8-6 MOE gapmers with mixed PO/PS internucleoside linkages complementary to human SCN2A

| Compound ID | SEQUENCE (5' to 3') | SEQ ID NO: 1 Start Site | SEQ ID NO: 1 Stop Site | SEQ ID NO: 2 Start Site | SEQ ID NO: 2 Stop Site | SEQ ID NO. |
|---|---|---|---|---|---|---|
| 1348917 | CTATTTTATAAATGCCGA | N/A | N/A | 229453 | 229470 | 2532 |
| 1348920 | TCTGCATGTAACCTTTAT | N/A | N/A | 243920 | 243937 | 2533 |
| 1348922 | CTGCATGTAACCTTTATA | N/A | N/A | 243919 | 243936 | 2534 |
| 1348923 | TGCATGTAACCTTTATAC | N/A | N/A | 243918 | 243935 | 2535 |
| 1348924 | TCTATTTTATAAATGCCG | N/A | N/A | 229454 | 229471 | 2536 |
| 1348925 | GCATGTAACCTTTATACA | N/A | N/A | 243917 | 243934 | 2537 |
| 1348926 | CATGTAACCTTTATACAT | N/A | N/A | 243916 | 243933 | 2538 |

The modified oligonucleotides in Table 55 below are 6-8-4 MOE gapmers. The gapmers are 18 nucleosides in length, wherein the central gap segment consists of eight 2'-β-D-deoxynucleosides, the 5' wing segment consists of six 2'-MOE nucleosides, and the 3' wing segment consists of four 2'-MOE nucleosides. The sugar motif for the gapmers is (from 5' to 3'): eeeeeeddddddddeeee; wherein 'd' represents a 2'-β-D-deoxyribosyl sugar moiety, and 'e' represents a 2'-MOE sugar moiety. The gapmers have an internucleoside linkage motif of (from 5' to 3'): soooosssssssssoss; wherein each "s" represents a phosphorothioate internucleoside linkage and each "o" represents a phosphodiester internucleoside linkage. Each cytosine residue is a 5-methyl cytosine.

TABLE 55

6-8-4 MOE gapmers with mixed PO/PS internucleoside linkages complementary to human SCN2A

| Compound ID | SEQUENCE (5' to 3') | SEQ ID NO: 1 Start Site | SEQ ID NO: 1 Stop Site | SEQ ID NO: 2 Start Site | SEQ ID NO: 2 Stop Site | SEQ ID NO. |
|---|---|---|---|---|---|---|
| 1348918 | CATGTAACC TTTATACAT | N/A | N/A | 243916 | 243933 | 2538 |
| 1348919 | TCTATTTTA TAAATGCCG | N/A | N/A | 229454 | 229471 | 2536 |
| 1348927 | GCATGTAAC CTTTATACA | N/A | N/A | 243917 | 243934 | 2537 |
| 1348931 | CTGCATGTA ACCTTTATA | N/A | N/A | 243919 | 243936 | 2534 |
| 1348934 | TCTGCATGT AACCTTTAT | N/A | N/A | 243920 | 243937 | 2533 |
| 1348935 | TGCATGTAA CCTTTATAC | N/A | N/A | 243918 | 243935 | 2535 |
| 1348936 | ACCCAGTTT TTTCATTGC | 4776 | 4793 | 254144 | 254161 | 2539 |

The modified oligonucleotides in Table 56 below are 5-8-5 MOE gapmers. The gapmers are 18 nucleosides in length, wherein the central gap segment consists of eight 2'-β-D-deoxynucleosides, the 5' wing segment consists of five 2'-MOE nucleosides, and the 3' wing segment consists of five 2'-MOE nucleosides. The sugar motif for the gapmers is (from 5' to 3'): eeeeedddddddddeeeee; wherein 'd' represents a 2'-β-D-deoxyribosyl sugar moiety, and 'e' represents a 2'-MOE sugar moiety. The gapmers have an internucleoside linkage motif of (from 5' to 3'): sooossssssssssooss; wherein each "s" represents a phosphorothioate internucleoside linkage and each "o" represents a phosphodiester internucleoside linkage. Each cytosine residue is a 5-methyl cytosine.

TABLE 56

5-8-5 MOE gapmers with mixed PO/PS internucleoside linkages complementary to human SCN2A

| Compound ID | SEQUENCE (5' to 3') | SEQ ID NO: Start Site | SEQ ID NO: Stop Site | SEQ ID NO: Start Site | SEQ ID NO: Stop Site | SEQ ID NO. |
|---|---|---|---|---|---|---|
| 1348928 | GCATGTAAC CTTTATACA | N/A | N/A | 243917 | 243934 | 2537 |

TABLE 56 -continued 5-8-5 MOE gapmers with mixed PO/PS internucleoside linkages complementary to human SCN2A

| Compound ID | SEQUENCE (5' to 3') | SEQ ID NO: Start Site | SEQ ID NO: Stop Site | SEQ ID NO: Start Site | SEQ ID NO: Stop Site | SEQ ID NO. |
|---|---|---|---|---|---|---|
| 1348929 | TGCATGTAA CCTTTATAC | N/A | N/A | 243918 | 243935 | 2535 |
| 1348930 | CATGTAACC TTTATACAT | N/A | N/A | 243916 | 243933 | 2538 |
| 1348932 | TCTATTTTA TAAATGCCG | N/A | N/A | 229454 | 229471 | 2536 |
| 1348933 | CTATTTTAT AAATGCCGA | N/A | N/A | 229453 | 229470 | 2532 |
| 1348937 | CTGCATGTA ACCTTTATA | N/A | N/A | 243919 | 243936 | 2534 |
| 1348938 | TCTGCATGT AACCTTTAT | N/A | N/A | 243920 | 243937 | 2533 |
| 1348939 | ACCCAGTTT TTTCATTGC | 4776 | 4793 | 254144 255537 | 254161 255554 | 2539 |

Example 4: Tolerability of Modified Oligonucleotides Complementary to Human SCN2A in Wild-Type Mice, 3 Hour Study Modified oligonucleotides described above were tested in wild-type female 057/1316 mice to assess the tolerability of the oligonucleotides. Additionally, Comparator Compound No. 1506060 was tested. Wild-type female C57/B16 mice each received a single ICV dose of 700 μg of modified oligonucleotide as listed in the tables below. Each treatment group consisted of 3 mice. A group of 4 mice received PBS as a negative control for each experiment (identified in separate tables below). At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the muse demonstrated any movement after it was lifted: (6) the mouse responded to tail pinching, (7) regular breathing. For each of the 7 criteria, a mouse was given a subscore of 0 if it met the criteria and 1 if it did not (the functional observational battery scow, or FOB). After all 7 criteria were evaluated, the scores were summed for each mouse and averaged within each treatment group.

TABLE 57

Tolerability scores in mice at 700 μg dose

| Compound ID | 3 hr. FOB |
|---|---|
| PBS | 0.00 |
| 1248353 | 4.00 |
| 1248354 | 1.33 |
| 1248355 | 2.67 |
| 1248356 | 3.33 |
| 1248357 | 2.33 |

TABLE 57-continued

Tolerability scores in mice at 700 μg dose

| Compound ID | 3 hr. FOB |
|---|---|
| 1248358 | 2.67 |
| 1248366 | 0.00 |
| 1248368 | 1.00 |
| 1248369 | 1.33 |
| 1248396 | 0.00 |
| 1248398 | 1.67 |
| 1248400 | 4.00 |
| 1248414 | 0.67 |
| 1248425 | 0.33 |
| 1248430 | 7.00 |
| 1248439 | 1.00 |
| 1248440 | 0.67 |
| 1248441 | 1.33 |
| 1248461 | 2.00 |
| 1248462 | 1.33 |
| 1248466 | 1.00 |
| 1248476 | 1.00 |
| 1248481 | 1.00 |
| 1248487 | 0.00 |

TABLE 58

Tolerability scores in mice at 700 μg dose

| Compound ID | 3 hr. FOB |
|---|---|
| PBS | 0.00 |
| 1248429 | 1.00 |
| 1249990 | 1.00 |
| 1250148 | 0.00 |
| 1250225 | 0.00 |

TABLE 59

Tolerability scores in mice at 700 μg dose

| Compound ID | 3 hr. FOB |
|---|---|
| PBS | 0.00 |
| 910009 | 0.00 |
| 1248427 | 0.00 |
| 1248428 | 1.00 |
| 1248431 | 0.00 |
| 1248488 | 1.67 |
| 1248531 | 0.33 |
| 1249989 | 0.00 |
| 1348240 | 1.00 |
| 1348241 | 1.67 |
| 1348242 | 0.67 |
| 1348243 | 1.67 |
| 1348244 | 1.00 |
| 1348245 | 0.00 |
| 1348248 | 0.00 |
| 1348250 | 3.00 |
| 1348251 | 1.00 |
| 1348252 | 1.00 |
| 1348253 | 0.00 |
| 1348254 | 0.00 |
| 1348255 | 0.00 |
| 1348256 | 0.00 |
| 1348257 | 0.33 |
| 1348258 | 1.33 |
| 1348259 | 1.00 |
| 1348263 | 0.00 |
| 1348264 | 0.00 |
| 1348265 | 0.00 |
| 1348266 | 0.00 |
| 1348267 | 0.00 |
| 1348269 | 0.00 |
| 1348270 | 1.00 |
| 1348271 | 0.00 |

TABLE 59-continued

Tolerability scores in mice at 700 μg dose

| Compound ID | 3 hr. FOB |
|---|---|
| 1348275 | 0.00 |
| 1348277 | 0.00 |
| 1348279 | 0.00 |

TABLE 60

Tolerability scores in mice at 700 μg dose

| Compound ID | 3 hr. FOB |
|---|---|
| PBS | 0.00 |
| 1348282 | 1.00 |
| 1348286 | 1.00 |
| 1348289 | 1.00 |
| 1348290 | 0.00 |
| 1348291 | 0.00 |
| 1348292 | 0.00 |
| 1348295 | 2.00 |
| 1348297 | 0.00 |
| 1348298 | 0.00 |
| 1348299 | 0.00 |
| 1348300 | 1.00 |
| 1348302 | 0.00 |
| 1348303 | 0.00 |
| 1348304 | 0.00 |
| 1348306 | 0.00 |
| 1348307 | 0.00 |
| 1348308 | 0.00 |
| 1348309 | 0.00 |
| 1348310 | 0.00 |
| 1348311 | 1.00 |
| 1348312 | 1.67 |
| 1348313 | 0.00 |
| 1348316 | 0.00 |
| 1348319 | 0.00 |
| 1348320 | 0.00 |
| 1348321 | 0.00 |
| 1348322 | 1.67 |
| 1348323 | 1.00 |
| 1348324 | 2.33 |
| 1348325 | 0.33 |
| 1348326 | 3.00 |
| 1348327 | 2.00 |
| 1348376 | 0.33 |
| 1348377 | 1.00 |
| 1348378 | 1.00 |
| 1348379 | 1.67 |
| 1348380 | 1.00 |
| 1348381 | 0.00 |
| 1348382 | 0.00 |
| 1348383 | 2.00 |
| 1348384 | 0.33 |
| 1348385 | 1.00 |
| 1348386 | 0.33 |
| 1348387 | 0.00 |
| 1348388 | 0.00 |

TABLE 61

Tolerability scores in mice at 700 μg dose

| Compound ID | 3 hr. FOB |
|---|---|
| PBS | 0.00 |
| 1348328 | 1.67 |
| 1348329 | 0.00 |
| 1348331 | 0.00 |
| 1348332 | 0.00 |
| 1348333 | 0.00 |
| 1348334 | 0.00 |
| 1348335 | 0.00 |

TABLE 61-continued

Tolerability scores in mice at 700 μg dose

| Compound ID | 3 hr. FOB |
|---|---|
| 1348336 | 0.00 |
| 1348337 | 0.00 |
| 1348338 | 0.00 |
| 1348340 | 0.00 |
| 1348341 | 0.00 |
| 1348342 | 0.00 |
| 1348343 | 0.00 |
| 1348344 | 0.00 |
| 1348345 | 0.00 |
| 1348347 | 0.00 |
| 1348348 | 0.00 |
| 1348350 | 0.00 |
| 1348353 | 4.00 |
| 1348355 | 0.00 |
| 1348356 | 0.00 |
| 1348358 | 0.00 |
| 1348360 | 1.00 |
| 1348361 | 1.00 |
| 1348362 | 0.00 |

TABLE 62

Tolerability scores in mice at 700 μg dose

| Compound ID | 3 hr. FOB |
|---|---|
| PBS | 0.00 |
| 1348364 | 1.00 |
| 1348365 | 0.00 |
| 1348366 | 0.00 |
| 1348367 | 0.00 |
| 1348369 | 1.00 |
| 1348370 | 0.00 |
| 1348371 | 0.00 |
| 1348373 | 1.00 |
| 1348374 | 2.00 |
| 1348375 | 0.00 |
| 1348392 | 0.00 |
| 1348393 | 0.00 |
| 1348394 | 0.00 |
| 1348395 | 0.00 |
| 1348396 | 0.00 |
| 1348397 | 0.00 |
| 1348399 | 0.00 |
| 1348424 | 0.00 |
| 1348425 | 0.00 |
| 1348426 | 0.00 |
| 1348427 | 0.00 |
| 1348428 | 0.00 |
| 1348429 | 1.00 |
| 1348430 | 3.00 |
| 1348433 | 1.00 |
| 1348434 | 0.00 |
| 1348435 | 0.00 |
| 1348436 | 0.00 |
| 1348437 | 0.00 |
| 1348438 | 0.00 |
| 1348448 | 1.00 |
| 1348449 | 0.00 |
| 1348450 | 2.00 |
| 1348451 | 0.00 |
| 1348453 | 0.00 |
| 1348455 | 0.00 |
| 1348456 | 0.00 |
| 1348917 | 0.00 |
| 1348918 | 0.00 |
| 1348919 | 1.00 |
| 1348920 | 2.00 |
| 1348922 | 1.00 |
| 1348923 | 0.00 |

TABLE 63

Tolerability scores in mice at 700 μg dose

| Compound ID | 3 hr. FOB |
|---|---|
| PBS | 0.00 |
| 1348315 | 0.00 |
| 1348403 | 2.33 |
| 1348404 | 0.00 |
| 1348405 | 2.67 |
| 1348406 | 2.67 |
| 1348407 | 0.00 |
| 1348408 | 0.00 |
| 1348410 | 2.67 |
| 1348411 | 1.00 |
| 1348412 | 0.00 |
| 1348413 | 0.00 |
| 1348414 | 1.00 |
| 1348415 | 0.67 |
| 1348416 | 0.00 |
| 1348417 | 1.00 |
| 1348418 | 0.00 |
| 1348419 | 0.00 |
| 1348420 | 1.00 |
| 1348421 | 1.00 |
| 1348422 | 0.00 |
| 1348423 | 2.00 |
| 1348439 | 0.00 |
| 1348440 | 0.00 |
| 1348441 | 0.00 |
| 1348442 | 0.00 |
| 1348443 | 1.00 |
| 1348444 | 0.00 |
| 1348445 | 2.00 |
| 1348446 | 1.33 |
| 1348924 | 1.00 |
| 1348925 | 0.00 |
| 1348926 | 0.00 |
| 1348927 | 0.33 |
| 1348928 | 0.00 |
| 1348929 | 0.00 |
| 1348930 | 0.00 |
| 1348931 | 0.00 |
| 1348932 | 1.33 |
| 1348933 | 0.00 |
| 1348934 | 0.33 |
| 1348935 | 0.00 |
| 1348936 | 2.00 |
| 1348937 | 1.00 |
| 1348938 | 1.00 |
| 1348939 | 1.33 |

TABLE 64

Tolerability scores in mice at 700 μg dose

| Compound ID | 3 hr. FOB |
|---|---|
| PBS | 0.00 |
| 1348447 | 0.00 |

TABLE 65

Tolerability scores in mice at 700 μg dose

| Compound ID | 3 hr. FOB |
|---|---|
| PBS | 0.00 |
| 1348259 | 0.00 |
| 1348289 | 0.00 |
| 1348290 | 0.00 |
| 1348331 | 0.00 |
| 1348347 | 0.00 |
| 1348937 | 0.00 |

TABLE 66

Tolerability scores in mice at 700 μg dose

| Compound No. | 3 hr. FOB |
|---|---|
| PBS | 0.00 |
| 1506060 | 6.00 |

Example 5: Tolerability of Modified Oligonucleotides Complementary to Human SCN2A in Rats, 3 mg Dose Modified oligonucleotides described above were tested in rats to assess the tolerability of the oligonucleotides. Sprague Dawley rats each received a single intrathecal (IT) dose of 3 mg of modified oligonucleotide listed in the tables below. Each treatment gimp consisted of 3-4 rats. A group of 4 rats received PBS as a negative control for each experiment (identified in separate tables below). At 3 hours post-infection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scones were summed for each rat and then averaged for each group. For example, if a rat's tail, head, and all other evaluated body parts were moving 3 hours after the 3 mg IT dose, it would get a summed score of 0. If another rat was not moving its tail 3 hours after the 3 mg IT dose but all other evaluated body parts were moving, it would receive a score of 1. The scores were averaged for each treatment group, and presented in the tables below. Values marked with the symbol "‡" indicate groups that had 3 or fewer animals in the group.

TABLE 67

Tolerability scores in rats at 3 mg dose

| Compound ID | 3 hr. FOB |
|---|---|
| PBS | 0.00 |
| 1248429 | 2.00 |
| 1248487 | 0.25 |
| 1249990 | 2.00‡ |
| 1250148 | 0.00‡ |
| 1250225 | 0.25 |

TABLE 68

Tolerability scores in rats at 3 mg dose

| Compound ID | 3 hr. FOB |
|---|---|
| PBS | 0.00 |
| 910009 | 1.00 |
| 1248427 | 0.00 |
| 1248428 | 1.00 |
| 1248431 | 0.67 |
| 1248488 | 1.33 |
| 1248531 | 0.33 |
| 1249989 | 1.33 |
| 1348240 | 0.33 |
| 1348241 | 0.00 |
| 1348242 | 0.00 |
| 1348243 | 3.00 |

TABLE 68-continued

Tolerability scores in rats at 3 mg dose

| Compound ID | 3 hr. FOB |
|---|---|
| 1348244 | 1.67 |
| 1348245 | 0.67 |
| 1348248 | 0.33 |
| 1348250 | 3.00 |
| 1348251 | 2.33 |
| 1348252 | 0.33 |
| 1348253 | 1.67 |
| 1348254 | 0.00 |
| 1348255 | 0.33 |
| 1348256 | 1.00 |
| 1348257 | 0.33 |
| 1348258 | 1.00 |
| 1348259 | 0.67 |
| 1348263 | 0.00 |

TABLE 69

Tolerability scores in rats at 3 mg dose

| Compound ID | 3 hr. FOB |
|---|---|
| PBS | 0.00 |
| 1348264 | 0.00 |
| 1348265 | 0.33 |
| 1348266 | 0.00 |
| 1348267 | 0.00 |
| 1348269 | 0.00 |
| 1348270 | 2.67 |
| 1348271 | 2.00 |
| 1348275 | 0.00 |
| 1348277 | 0.33 |
| 1348279 | 0.00 |
| 1348282 | 2.33 |
| 1348286 | 2.33 |
| 1348289 | 0.00 |
| 1348290 | 0.00 |
| 1348291 | 0.00 |
| 1348292 | 0.00 |
| 1348295 | 2.33 |

TABLE 70

Tolerability scores in rats at 3 mg dose

| Compound ID | 3 hr. FOB |
|---|---|
| PBS | 0.00 |
| 1348297 | 0.33 |
| 1348298 | 1.33 |
| 1348299 | 1.33 |
| 1348300 | 2.33 |
| 1348302 | 0.00 |
| 1348303 | 0.00 |
| 1348304 | 0.33 |

TABLE 71

Tolerability scores in rats at 3 mg dose

| Compound ID | 3 hr. FOB |
|---|---|
| PBS | 0.00 |
| 1348306 | 0.67 |
| 1348307 | 3.00 |
| 1348308 | 0.00 |
| 1348309 | 1.00 |
| 1348310 | 0.67 |
| 1348311 | 2.00 |

TABLE 71-continued

Tolerability scores in rats at 3 mg dose

| Compound ID | 3 hr. FOB |
|---|---|
| 1348312 | 2.00 |
| 1348313 | 2.00 |

TABLE 72

Tolerability scores in rats at 3 mg dose

| Compound ID | 3 hr. FOB |
|---|---|
| PBS | 0.00 |
| 1348316 | 0.33 |
| 1348319 | 1.67 |
| 1348320 | 0.33 |
| 1348321 | 0.00 |
| 1348322 | 0.00‡ |
| 1348323 | 1.33 |
| 1348324 | 2.00 |
| 1348325 | 0.33 |
| 1348326 | 2.67 |
| 1348327 | 3.00 |
| 1348376 | 0.67 |
| 1348377 | 0.67 |
| 1348378 | 0.67 |
| 1348379 | 1.33 |
| 1348380 | 0.67 |
| 1348381 | 0.67 |
| 1348382 | 0.67 |
| 1348383 | 2.00 |
| 1348384 | 0.00 |
| 1348385 | 0.00 |
| 1348386 | 0.00 |
| 1348387 | 0.00 |
| 1348388 | 0.33 |

TABLE 73

Tolerability scores in rats at 3 mg dose

| Compound ID | 3 hr. FOB |
|---|---|
| PBS | 0.00 |
| 1348328 | 2.33 |
| 1348329 | 0.33 |
| 1348331 | 0.33 |
| 1348332 | 0.67 |
| 1348333 | 0.33 |
| 1348334 | 0.00 |
| 1348335 | 0.33 |
| 1348336 | 0.33 |
| 1348337 | 0.00 |
| 1348338 | 1.00 |
| 1348340 | 0.00 |
| 1348341 | 0.00 |
| 1348342 | 0.00 |
| 1348343 | 1.33 |
| 1348344 | 1.00 |
| 1348345 | 1.33 |
| 1348347 | 0.33 |

TABLE 74

Tolerability scores in rats at 3 mg dose

| Compound ID | 3 hr. FOB |
|---|---|
| PBS | 0.25 |
| 1348348 | 0.67 |
| 1348350 | 1.33 |
| 1348353 | 1.67 |

TABLE 74-continued

Tolerability scores in rats at 3 mg dose

| Compound ID | 3 hr. FOB |
|---|---|
| 1348355 | 0.00 |
| 1348356 | 0.00 |
| 1348358 | 0.00 |
| 1348360 | 2.00 |
| 1348361 | 2.67 |
| 1348362 | 2.00 |
| 1348364 | 2.67 |
| 1348365 | 1.33 |
| 1348366 | 1.00 |
| 1348367 | 1.67 |
| 1348369 | 0.33 |
| 1348370 | 0.33 |
| 1348371 | 0.67 |
| 1348373 | 3.00 |
| 1348374 | 3.33 |
| 1348375 | 0.67 |
| 1348392 | 0.33 |

TABLE 75

Tolerability scores in rats at 3 mg dose

| Compound ID | 3 hr. FOB |
|---|---|
| PBS | 0.00 |
| 1348393 | 1.33 |
| 1348394 | 0.67 |
| 1348395 | 0.00 |
| 1348396 | 0.00 |
| 1348397 | 1.33 |
| 1348399 | 0.00 |
| 1348424 | 2.33 |
| 1348425 | 0.00 |
| 1348426 | 0.00 |
| 1348427 | 2.00 |
| 1348428 | 0.00 |
| 1348429 | 1.67 |
| 1348430 | 3.00 |
| 1348433 | 0.00 |
| 1348434 | 0.00 |
| 1348435 | 0.00 |
| 1348436 | 0.00 |
| 1348437 | 0.00 |
| 1348438 | 0.33 |
| 1348448 | 2.00 |
| 1348449 | 0.00 |
| 1348450 | 2.67 |

TABLE 76

Tolerability scores in rats at 3 mg dose

| Compound ID | 3 hr. FOB |
|---|---|
| PBS | 0.25 |
| 1348451 | 3.00 |
| 1348453 | 1.33 |
| 1348455 | 1.33 |
| 1348456 | 0.00 |
| 1348917 | 1.00 |
| 1348918 | 0.00 |
| 1348919 | 2.00 |
| 1348920 | 3.00 |
| 1348922 | 2.67 |
| 1348923 | 1.67 |
| 1348924 | 3.00 |
| 1348925 | 3.00 |
| 1348926 | 0.00 |
| 1348927 | 0.33 |
| 1348928 | 0.33 |
| 1348929 | 0.00 |

TABLE 76-continued

Tolerability scores in rats at 3 mg dose

| Compound ID | 3 hr. FOB |
|---|---|
| 1348930 | 0.00 |
| 1348931 | 0.00 |
| 1348932 | 2.00 |
| 1348933 | 2.00 |
| 1348934 | 1.00 |
| 1348935 | 0.00 |
| 1348936 | 2.00 |
| 1348937 | 0.67 |
| 1348938 | 2.00 |
| 1348939 | 2.00 |

TABLE 77

Tolerability scores in rats at 3 mg dose

| Compound ID | 3 hr. FOB |
|---|---|
| PBS | 0.25 |
| 1348315 | 1.67 |
| 1348403 | 2.00 |
| 1348404 | 1.00 |
| 1348405 | 2.33 |
| 1348406 | 4.00 |
| 1348407 | 0.33 |
| 1348408 | 0.00 |
| 1348410 | 2.00 |
| 1348411 | 2.00 |
| 1348412 | 0.00 |
| 1348413 | 0.67 |

TABLE 78

Tolerability scores in rats at 3 mg dose

| Compound ID | 3 hr. FOB |
|---|---|
| PBS | 0.00 |
| 1348414 | 3.00 |
| 1348415 | 2.00 |
| 1348416 | 0.67 |
| 1348417 | 0.67 |
| 1348418 | 0.00 |
| 1348419 | 0.00 |
| 1348420 | 2.00 |
| 1348421 | 2.00 |
| 1348422 | 1.33 |
| 1348423 | 3.00 |

TABLE 79

Tolerability scores in rats at 3 mg dose

| Compound ID | 3 hr. FOB |
|---|---|
| PBS | 0.00 |
| 1348439 | 2.67 |
| 1348440 | 0.33 |
| 1348441 | 1.00 |
| 1348442 | 0.00 |
| 1348443 | 1.00 |

TABLE 80

Tolerability scores in rats at 3 mg dose

| Compound ID | 3 hr. FOB |
|---|---|
| PBS | 0.00 |
| 1348444 | 0.00 |
| 1348445 | 3.00 |
| 1348446 | 0.00 |
| 1348447 | 0.67 |

TABLE 81

Tolerability scores in rats at 3 mg dose

| Compound ID | 3 hr. FOB |
|---|---|
| PBS | 0.25 |
| 1348259 | 0.75 |
| 1348289 | 0.50 |
| 1348290 | 0.75 |
| 1348331 | 1.00 |
| 1348347 | 0.50 |
| 1348937 | 1.25 |

Example 6: Effect of Modified Oligonucleotides on Human SCN2A RNA In Vitro, Multiple Doses Modified oligonucleotides selected from the examples above were tested at various doses in SH-SY5Y cells. Cultured SH-SY5Y cells at a density of 20,000 cells per well were treated using electroporation with various concentrations of modified oligonucleotide as specified in the tables below. After a treatment period of approximately 24 hours, total RNA was isolated from the cells and SCN2A RNA levels were measured by quantitative real-time RTPCR. Human SCN2A primer-probe set RTS36041 (described herein above) was used to measure RNA levels. SCN2A RNA levels were normalized to total RNA content, as measured by GAPDH. Levels of GAPDH were measured using human primer probe set RTS104 (forward sequence GAAGGTGAAGGTCGGAGTC, designated herein as SEQ ID NO: 7; reverse sequence GAAGATGGTGATGGGAT-TTC, designated herein as SEQ ID NO: 8; probe sequence CAAGCTTCCCGTTCTCAGCC, designated herein as SEQ ID NO: 9). Reduction of SCN2A RNA is presented in the tables below as percent SCN2A RNA relative to the amount in untreated control cells (% control). The results for each separate experiment are presented in separate tables below.

The half maximal inhibitory concentration ($IC_{50}$) of each modified oligonucleotide was calculated using a linear regression on a log/linear plot of the data in Excel.

TABLE 82

Dose-dependent reduction of human SCN2A RNA in SH-SY5Y cells by modified oligonucleotides

| Compound No. | SCN2A RNA (% control) | | | | | $IC_{50}$ (µM) |
|---|---|---|---|---|---|---|
| | 39 nM | 156 nM | 625 nM | 2500 nM | 10000 nM | |
| 910009 | 81 | 62 | 49 | 25 | 12 | 0.5 |
| 1248427 | 73 | 74 | 49 | 31 | 23 | 0.6 |
| 1348253 | 59 | 42 | 27 | 15 | 5 | 0.1 |
| 1348259 | 89 | 66 | 33 | 22 | 11 | 0.4 |
| 1348290 | 60 | 51 | 30 | 17 | 17 | 0.1 |
| 1348291 | 96 | 71 | 34 | 24 | 6 | 0.5 |
| 1348316 | 78 | 61 | 33 | 11 | 7 | 0.3 |

TABLE 82-continued

Dose-dependent reduction of human SCN2A RNA in SH-SY5Y cells by modified oligonucleotides

| Compound No. | SCN2A RNA (% control) | | | | | IC$_{50}$ (µM) |
|---|---|---|---|---|---|---|
| | 39 nM | 156 nM | 625 nM | 2500 nM | 10000 nM | |
| 1348320 | 90 | 64 | 53 | 25 | 18 | 0.6 |
| 1348343 | 94 | 80 | 58 | 33 | 13 | 0.9 |
| 1348371 | 90 | 70 | 62 | 34 | 13 | 0.8 |
| 1348411 | 118 | 92 | 95 | 73 | 17 | 3.9 |
| 1348435 | 82 | 116 | 76 | 34 | 11 | 1.5 |
| 1348444 | 111 | 77 | 48 | 19 | 3 | 0.7 |
| 1348935 | 67 | 60 | 47 | 35 | 17 | 0.4 |

TABLE 83

Dose-dependent reduction of human SCN2A RNA in SH-SY5Y cells by modified oligonucleotides

| Compound No. | SCN2A RNA (% control) | | | | | IC$_{50}$ (µM) |
|---|---|---|---|---|---|---|
| | 39 nM | 156 nM | 625 nM | 2500 nM | 10000 nM | |
| 1248487 | 133 | 168 | 103 | 63 | 10 | 3.8 |
| 1348266 | 106 | 100 | 85 | 40 | 21 | 2.1 |
| 1348292 | 101 | 96 | 69 | 33 | 21 | 1.5 |
| 1348328 | 72 | 72 | 63 | 30 | 12 | 0.6 |
| 1348345 | 110 | 112 | 77 | 43 | 19 | 2.1 |
| 1348347 | 94 | 73 | 43 | 17 | 12 | 0.5 |
| 1348373 | 94 | 82 | 36 | 13 | 9 | 0.5 |
| 1348374 | 106 | 92 | 63 | 37 | 23 | 1.5 |
| 1348417 | 106 | 92 | 45 | 32 | 12 | 0.9 |
| 1348420 | 111 | 106 | 122 | 120 | 138 | >10.0 |
| 1348436 | 128 | 120 | 81 | 45 | 13 | 2.2 |
| 1348438 | 95 | 90 | 84 | 46 | 36 | 3.5 |
| 1348447 | 169 | 123 | 98 | 41 | 13 | 2.4 |
| 1348936 | 126 | 148 | 92 | 83 | 29 | 7.2 |

TABLE 84

Dose-dependent reduction of human SCN2A RNA in SH-SY5Y cells by modified oligonucleotides

| Compound No. | SCN2A RNA (% control) | | | | | IC$_{50}$ (µM) |
|---|---|---|---|---|---|---|
| | 39 nM | 156 nM | 625 nM | 2500 nM | 10000 nM | |
| 1248488 | 133 | 118 | 57 | 26 | 11 | 1.4 |
| 1249990 | 103 | 102 | 52 | 35 | 19 | 1.3 |
| 1348271 | 84 | 106 | 71 | 36 | 13 | 1.4 |
| 1348275 | 106 | 111 | 109 | 93 | 110 | >10.0 |
| 1348302 | 99 | 89 | 48 | 17 | 7 | 0.7 |
| 1348331 | 111 | 97 | 62 | 21 | 9 | 1.0 |
| 1348360 | 98 | 97 | 80 | 28 | 10 | 1.3 |
| 1348376 | 86 | 80 | 69 | 39 | 10 | 1.0 |
| 1348421 | 97 | 91 | 66 | 34 | 19 | 1.3 |
| 1348439 | 93 | 71 | 42 | 21 | 19 | 0.6 |
| 1348449 | 111 | 91 | 61 | 24 | 13 | 1.1 |
| 1348456 | 100 | 83 | 60 | 31 | 22 | 1.1 |
| 1348937 | 81 | 88 | 65 | 33 | 12 | 0.9 |
| 1348938 | 93 | 65 | 56 | 37 | 26 | 1.0 |

TABLE 85

Dose-dependent reduction of human SCN2A RNA in SH-SY5Y cells by modified oligonucleotides

| Compound No. | SCN2A RNA (% control) | | | | | IC$_{50}$ (µM) |
|---|---|---|---|---|---|---|
| | 39 nM | 156 nM | 625 nM | 2500 nM | 10000 nM | |
| 1250148 | 93 | 73 | 56 | 20 | 8 | 0.6 |
| 1348277 | 80 | 70 | 59 | 27 | 13 | 0.6 |

TABLE 85-continued

Dose-dependent reduction of human SCN2A RNA in SH-SY5Y cells by modified oligonucleotides

| Compound No. | SCN2A RNA (% control) | | | | | IC$_{50}$ (µM) |
|---|---|---|---|---|---|---|
| | 39 nM | 156 nM | 625 nM | 2500 nM | 10000 nM | |
| 1348303 | 109 | 80 | 34 | 12 | 23 | 0.7 |
| 1348304 | 85 | 74 | 54 | 28 | 11 | 0.6 |
| 1348332 | 95 | 56 | 58 | 23 | 28 | 0.7 |
| 1348333 | 75 | 81 | 48 | 30 | 14 | 0.6 |
| 1348365 | 96 | 80 | 72 | 37 | 14 | 1.2 |
| 1348366 | 136 | 84 | 72 | 39 | 89 | >10.0 |
| 1348383 | 77 | 75 | 42 | 21 | 14 | 0.4 |
| 1348384 | 100 | 76 | 60 | 44 | 19 | 1.3 |
| 1348422 | 94 | 82 | 72 | 25 | 11 | 0.9 |
| 1348440 | 104 | 80 | 19 | 15 | 13 | 0.5 |
| 1348923 | 107 | 89 | 84 | 46 | 16 | 2.0 |
| 1348939 | 96 | 85 | 60 | 37 | 15 | 1.1 |

TABLE 86

Dose-dependent reduction of human SCN2A RNA in SH-SY5Y cells by modified oligonucleotides

| Compound No. | SCN2A RNA (% control) | | | | | IC$_{50}$ (µM) |
|---|---|---|---|---|---|---|
| | 39 nM | 156 nM | 625 nM | 2500 nM | 10000 nM | |
| 1250225 | 91 | 119 | 56 | 32 | 13 | 1.2 |
| 1348251 | 91 | 91 | 88 | 55 | 24 | 3.2 |
| 1348282 | 117 | 90 | 52 | 38 | 15 | 1.2 |
| 1348289 | 81 | 64 | 39 | 25 | 12 | 0.4 |
| 1348306 | 79 | 75 | 51 | 22 | 13 | 0.5 |
| 1348338 | 89 | 72 | 35 | 13 | 16 | 0.4 |
| 1348369 | 107 | 121 | 124 | 97 | 139 | >10.0 |
| 1348385 | 108 | 92 | 75 | 61 | 27 | 3.1 |
| 1348423 | 107 | 101 | 86 | 44 | 13 | 2.0 |
| 1348427 | 87 | 68 | 67 | 42 | 21 | 1.1 |
| 1348441 | 98 | 81 | 60 | 38 | 21 | 1.2 |
| 1348442 | 114 | 87 | 95 | 33 | 25 | 2.2 |
| 1348928 | 129 | 93 | 110 | 90 | 130 | >10.0 |
| 1348931 | 91 | 91 | 78 | 54 | 39 | 4.6 |

TABLE 87

Dose-dependent reduction of human SCN2A RNA in SH-SY5Y cells by modified oligonucleotides

| Compound No. | SCN2A RNA (% control) | | | | | IC$_{50}$ (µM) |
|---|---|---|---|---|---|---|
| | 39 nM | 156 nM | 625 nM | 2500 nM | 10000 nM | |
| 1348307 | 82 | 76 | 67 | 37 | 14 | 1.0 |
| 1348342 | 87 | 71 | 60 | 25 | 13 | 0.7 |
| 1348386 | 98 | 91 | 65 | 37 | 15 | 1.2 |
| 1348433 | 90 | 75 | 68 | 55 | 24 | 2.0 |
| 1348435 | 94 | 84 | 60 | 36 | 23 | 1.2 |
| 1348443 | 81 | 74 | 52 | 32 | 17 | 0.7 |
| 1348934 | 81 | 66 | 55 | 32 | 15 | 0.6 |

Example 7: Effect of Modified Oligonucleotides on Human SCN2A RNA In Vitro, Multiple Doses Modified oligonucleotides selected from the examples above were tested at various doses in SH-SY5Y cells. Cultured SH-SY5Y cells at a density of 35,000 cells per well were treated using electroporation with various concentrations of modified oligonucleotide as specified in the tables below. After a treatment period of approximately 24 hours, total RNA was isolated from the cells and SCN2A RNA levels were measured by quantitative real-time RTPCR.

Human SCN2A primer-probe set RTS36041 (described herein above) was used to measure RNA levels. SCN2A RNA levels were normalized to total RNA content, as measured by GAPDH. Levels of GAPDH were measured using human primer probe set RTS104 (forward sequence GAAGGGTGAAGGGTCGGAGTC, designated herein as SEQ ID NO: 7; reverse sequence GAAGATGGTGATGGGATTTC, designated herein as SEQ ID NO: 8; probe sequence CAAGCTTCCCGTTCTCAGCC, designated herein as SEQ ID NO: 9). Reduction of SCN2A RNA is presented in the tables below as percent SCN2A RNA relative to the amount in untreated control cells (% control).

The half maximal inhibitory concentration ($IC_{50}$) of each modified oligonucleotide was calculated in Graphpad Prism using log(inhibitor) vs. normalized response—Variable slope curve fitting.

TABLE 88

Dose-dependent reduction of human SCN2A RNA in SH-SY5Y cells by modified oligonucleotides

| Compound No. | SCN2A RNA (% control) | | | | | | | | | | $IC_{50}$ ($\mu M$) |
|---|---|---|---|---|---|---|---|---|---|---|---|
| | 0.005 nM | 0.013 nM | 0.032 nM | 0.08 nM | 0.2 nM | 0.5 nM | 1.28 nM | 3.2 nM | 8.0 nM | 20.0 nM | |
| 1348259 | 94 | 95 | 90 | 86 | 62 | 40 | 29 | 21 | 6 | 6 | 0.4 |
| 1348289 | 91 | 83 | 85 | 74 | 58 | 48 | 26 | 14 | 7 | 6 | 0.3 |
| 1348290 | 100 | 85 | 86 | 85 | 76 | 48 | 35 | 21 | 10 | 8 | 0.6 |
| 1348331 | 87 | 100 | 93 | 82 | 67 | 48 | 32 | 22 | 7 | 11 | 0.5 |
| 1348347 | 84 | 85 | 90 | 80 | 62 | 40 | 22 | 12 | 7 | 5 | 0.3 |
| 1348937 | 94 | 95 | 92 | 92 | 78 | 58 | 48 | 25 | 16 | 13 | 1.0 |

Example 8: Effect of Modified Oligonucleotides on Human SCN2A in Transgenic Mice Modified oligonucleotides described above were tested in a human SCN2A transgenic mouse model. Transgenic mice that express a human SCN2A transcript were generated in a C57B1/6 background. Transgenic mice may be prepared and are available from commercial and academic research facilities; for examples of transgenic mice that express human neurological genes see, for example, Heintz et al., 2002, Nature reviews Neuroscience 2, 861-870.

Treatment

Human SCN2A transgenic mice were divided into groups of 2 mice each. Each mouse received a single ICV bolus of 350 μg, of modified oligonucleotide. A group of 4 mice received PBS as a negative control.

RNA Analysis

Two weeks post treatment, mice were sacrificed, and RNA was extracted from cortical brain tissue and spinal cord for quantitative real-time RTPCR analysis to measure the amount of SCN2A RNA using Human primer probe set RTS36041 (described in Example 1 above). Results are presented as percent human SCN2A RNA relative to the amount in PBS treated animals, normalized to mouse GAPDH RNA (% control). Mouse GAPDH RNA was amplified using primer probe set mGapdh_LTS00102 (forward sequence GGCAAATCAACGGCACAGT designated herein as SEQ ID NO: 13; reverse sequence GGGTCTCGCTCCTGGAAGAT designated herein as SEQ ID NO: 14; probe sequence AAGGCCGAGAATGGGAAGCTTGTCATC, designated herein as SEQ ID NO: 15).

As shown in the tables below, treatment with modified oligonucleotides resulted in reduction of SCN2A RNA in comparison to the PBS control.

TABLE 89

Reduction of human SCN2A RNA in transgenic mice

| | SCN2A RNA (% control) | |
|---|---|---|
| Compound ID | CORTEX | SPINAL CORD |
| PBS | 100 | 100 |
| 1248353 | 58 | 65 |
| 1248354 | 62 | 69 |
| 1248357 | 76 | 84 |
| 1248358 | 65 | 74 |
| 1248368 | 109 | 83 |
| 1248369 | 113 | 91 |
| 1248396 | 57 | 70 |
| 1248398 | 102 | 77 |
| 1248400 | 59 | 63 |
| 1248414 | 73 | 66 |
| 1248425 | 83 | 71 |
| 1248441 | 77 | 72 |
| 1248461 | 87 | 73 |
| 1248462 | 84 | 73‡ |
| 1248466 | 58 | 50 |
| 1248476 | 45 | 42 |
| 1248481 | 71 | 66 |
| 1248487 | 24 | 35 |
| 1248489 | 36 | 29 |
| 1248510 | 48 | 44 |
| 1248526 | 68 | 62 |
| 1248543 | 111 | 81 |
| 1248585 | 73 | 60 |
| 1248593 | 37 | 64 |
| 1249160 | 62 | 82 |
| 1249161 | 48 | 78 |
| 1249164 | 46 | 59 |
| 1249169 | 49 | 73 |
| 1249170 | 53 | 80 |
| 1249204 | 50 | 81 |
| 1249205 | 43 | 76 |
| 1249210 | 52 | 76 |
| 1249222 | 46 | 61 |
| 1249225 | 44 | 60 |
| 1249237 | 43 | 48 |
| 1249252 | 80 | 87 |
| 1249266 | 76 | 85 |
| 1249269 | 58 | 70 |
| 1249272 | 74 | 71 |
| 1249273 | 89 | 90 |
| 1249274 | 83 | 84 |
| 1249282 | 53 | 63 |
| 1249284 | 69 | 80 |
| 1249286 | 46 | 62 |
| 1249295 | 97 | 100 |

TABLE 89-continued

Reduction of human SCN2A RNA in transgenic mice

| Compound ID | SCN2A RNA (% control) | |
|---|---|---|
| | CORTEX | SPINAL CORD |
| 1249296 | 121 | 87 |
| 1249297 | 103 | 91 |
| 1249298 | 65 | 76 |
| 1249313 | 84‡ | 76‡ |
| 1249315 | 57 | 75 |
| 1249316 | 57 | 86 |

‡indicates groups with only 1 PCR value

TABLE 90

Reduction of human SCN2A RNA in transgenic mice

| Compound ID | SCN2A RNA (% control) | |
|---|---|---|
| | CORTEX | SPINAL CORD |
| PBS | 100 | 100 |
| 1249328 | 43 | 58 |
| 1249337 | 54 | 53 |
| 1249338 | 36 | 51 |
| 1249340 | 35 | 51 |
| 1249341 | 37 | 50 |
| 1249377 | 63 | 66 |
| 1249390 | 33 | 46 |
| 1249401 | 43 | 58 |
| 1249403 | 63 | 75 |
| 1249406 | 55 | 65 |
| 1249416 | 44 | 63 |
| 1249417 | 30 | 46 |
| 1249418 | 35 | 47 |
| 1249428 | 54 | 54 |
| 1249445 | 54 | 64 |
| 1249482 | 81 | 72 |
| 1249483 | 89 | 70 |
| 1249484 | 65 | 60 |
| 1249485 | 55 | 56 |
| 1249486 | 71 | 80 |
| 1249495 | 62 | 67 |
| 1249536 | 73 | 83 |
| 1249588 | 45 | 58 |
| 1249599 | 50 | 64 |
| 1249613 | 57 | 61 |
| 1249633 | 80 | 88 |
| 1249639 | 79 | 69 |
| 1249675 | 54 | 53 |
| 1249677 | 112 | 81 |
| 1249685 | 68 | 67 |
| 1249726 | 42 | 42 |
| 1249728 | 66 | 60 |
| 1249729 | 66 | 54 |
| 1249800 | 54 | 45 |
| 1249822 | 65 | 75 |
| 1249867 | 70 | 72 |
| 1249873 | 85 | 69 |
| 1249953 | 28 | 39 |
| 1249990 | 22 | 46 |
| 1250021 | 86 | 69 |
| 1250065 | 54 | 34 |
| 1250070 | 89‡ | 63‡ |
| 1250148 | 13 | 25 |
| 1250149 | 26 | 36 |
| 1250161 | 62 | 66 |
| 1250164 | 60 | 64 |
| 1250184 | 55 | 53 |
| 1250225 | 16 | 23 |
| 1250235 | 49 | 60 |
| 1250238 | 73 | 93 |
| 1250239 | 65 | 70 |
| 1250266 | 53 | 64 |
| 909945 | 40 | 58 |
| 909947 | 40 | 48 |

TABLE 90-continued

Reduction of human SCN2A RNA in transgenic mice

| Compound ID | SCN2A RNA (% control) | |
|---|---|---|
| | CORTEX | SPINAL CORD |
| 909950 | 62 | 65 |
| 909951 | 62 | 68 |
| 909955 | 58 | 52 |
| 909962 | 66 | 75 |
| 909985 | 46 | 55 |
| 910015 | 38 | 47 |
| 910246 | 57 | 67 |
| 910263 | 38 | 51 |
| 910265 | 54 | 62 |
| 910269 | 35 | 52 |
| 910279 | 48 | 47 |
| 910342 | 42 | 44 |
| 910355 | 72 | 76 |
| 910356 | 69 | 80 |
| 910366 | 51 | 52 |
| 1248363 | 25 | 71 |
| 1248429 | 9 | 21 |
| 1248511 | 34 | 30 |
| 1249576 | 60 | 66 |
| 1249589 | 58 | 51 |
| 1249811 | 47 | 63 |
| 1250227 | 37 | 46 |
| 1250246 | 37 | 59 |
| 909533 | 59 | 57 |
| 909603 | 55 | 54 |
| 909995 | 36 | 40 |
| 910010 | 41 | 29 |
| 910061 | 78 | 77 |
| 910249 | 58 | 68 |
| 910250 | 81 | 74 |
| 910267 | 81 | 76 |
| 910307 | 72 | 69 |
| 910314 | 46‡ | 57 |
| 910315 | 68 | 73 |
| 910341 | 61 | 55 |
| 910372 | 70 | 59 |
| 1248423 | 63 | 63 |
| 1248444 | 62 | 69 |
| 1248474 | 83 | 81 |
| 1248490 | 84 | 82 |
| 1248672 | 59 | 82 |
| 1248717 | 45 | 57 |
| 1248728 | 61 | 70 |
| 1249320 | 53 | 65 |
| 1249346 | 63 | 66 |
| 1249361 | 76 | 65 |
| 1249501 | 116‡ | 40 |
| 1249533 | 78 | 65 |
| 1249687 | 38 | 45 |
| 1249789 | 71 | 70 |
| 1249967 | 55 | 60 |
| 1250101 | 53 | 52 |
| 1248355 | 41 | 60 |
| 1248356 | 43 | 67 |
| 1248366 | 43 | 39 |
| 1248430 | 31 | 28 |
| 1248439 | 39 | 42 |
| 1248440 | 36 | 43 |

‡indicates groups with only 1 PCR value

TABLE 91

Reduction of human SCN2A RNA in transgenic mice

| Compound ID | SCN2A RNA (% control) | |
|---|---|---|
| | CORTEX | SPINAL CORD |
| PBS | 100 | 100 |
| 910009 | 26 | 38 |
| 1248427 | 22 | 47 |

TABLE 91-continued

Reduction of human SCN2A RNA in transgenic mice

| Compound ID | SCN2A RNA (% control) | |
|---|---|---|
| | CORTEX | SPINAL CORD |
| 1248488 | 26 | 18 |
| 1248531 | 43 | 43 |
| 1249989 | 40 | 55 |
| 1348240 | 50 | 56 |
| 1348241 | 75 | 83 |
| 1348242 | 83 | 99 |
| 1348243 | 107 | 109 |
| 1348244 | 98 | 101 |
| 1348245 | 82 | 93 |
| 1348248 | 40 | 60 |
| 1348250 | 37 | 45 |
| 1348251 | 25 | 41 |
| 1348252 | 39 | 49 |
| 1348253 | 18 | 32 |
| 1348254 | 55 | 74 |
| 1348255 | 59 | 75 |
| 1348256 | 45 | 55 |
| 1348257 | 48 | 67 |
| 1348258 | 59 | 59 |
| 1348259 | 11 | 22 |
| 1348263 | 47 | 55 |
| 1348264 | 49 | 67 |
| 1348265 | 38 | 43 |
| 1348266 | 24 | 37 |
| 1348267 | 45 | 49 |
| 1348269 | 49 | 47 |
| 1348270 | 35 | 38 |
| 1348271 | 15 | 36 |
| 1348275 | 24 | 30 |
| 1348277 | 22 | 43 |
| 1348279 | 21 | 37 |
| 1348282 | 16 | 30 |
| 1348286 | 23 | 46 |
| 1348289 | 7 | 18 |
| 1348290 | 7 | 18 |
| 1348291 | 8 | 17 |
| 1348292 | 14 | 32 |
| 1348295 | 35 | 65 |
| 1348297 | 20 | 34 |
| 1348298 | 40 | 32 |
| 1348299 | 38 | 32 |
| 1348300 | 89 | 77 |
| 1348302 | 8 | 16 |
| 1348303 | 23 | 22 |
| 1348304 | 12 | 24 |
| 1348306 | 21 | 37 |
| 1348307 | 22 | 37 |
| 1348308 | 44 | 49 |
| 1348309 | 18 | 33 |
| 1348310 | 34 | 46 |
| 1348311 | 65 | 70 |
| 1348312 | 29 | 46 |
| 1348313 | 31 | 48 |
| 1348316 | 30 | 48 |
| 1348319 | 48 | 60 |
| 1348320 | 19 | 35 |
| 1348321 | 76 | 100 |
| 1348322 | 69 | 72 |
| 1348323 | 84 | 96 |
| 1348324 | 96 | 108 |
| 1348325 | 76 | 85 |
| 1348326 | 34 | 47 |
| 1348327 | 46 | 56 |
| 1348376 | 21 | 33 |
| 1348377 | 31 | 35 |
| 1348378 | 40 | 45 |
| 1348379 | 31 | 33 |
| 1348380 | 23 | 29 |
| 1348381 | 42 | 33 |
| 1348382 | 39 | 37 |
| 1348383 | 14 | 26 |
| 1348384 | 21 | 53 |
| 1348385 | 14 | 15 |
| 1348386 | 24 | 34 |

TABLE 91-continued

Reduction of human SCN2A RNA in transgenic mice

| Compound ID | SCN2A RNA (% control) | |
|---|---|---|
| | CORTEX | SPINAL CORD |
| 1348387 | 41 | 38 |
| 1348388 | 40 | 49 |
| 1348328 | 21 | 33 |
| 1348329 | 66 | 76 |

TABLE 92

Reduction of human SCN2A RNA in transgenic mice

| Compound ID | SCN2A RNA (% control) | |
|---|---|---|
| | CORTEX | SPINAL CORD |
| PBS | 100 | 100 |
| 1348331 | 12 | 21 |
| 1348332 | 14 | 27 |
| 1348333 | 15 | 21 |
| 1348334 | 49 | 53 |
| 1348335 | 35 | 42 |
| 1348336 | 50 | 46 |
| 1348337 | 43 | 51 |
| 1348338 | 17 | 23 |
| 1348340 | 50 | 48 |
| 1348341 | 49 | 48 |
| 1348342 | 21 | 22 |
| 1348343 | 27 | 37 |
| 1348344 | 39 | 37 |
| 1348345 | 29 | 32 |
| 1348347 | 11 | 20 |
| 1348348 | 33 | 32 |
| 1348350 | 54 | 86 |
| 1348353 | 36 | 39 |
| 1348355 | 52 | 51 |
| 1348356 | 46 | 53 |
| 1348358 | 25 | 42 |
| 1348360 | 27 | 40 |
| 1348361 | 23 | 46 |
| 1348362 | 33 | 37 |
| 1348364 | 16 | 33 |
| 1348365 | 17 | 35 |
| 1348366 | 26 | 45 |
| 1348367 | 16 | 35 |
| 1348369 | 15 | 36 |
| 1348370 | 29 | 39 |
| 1348371 | 26 | 33 |
| 1348373 | 15 | 20 |
| 1348374 | 20 | 37 |
| 1348375 | 49 | 49 |
| 1348392 | 62 | 56 |
| 1348393 | 33 | 43 |
| 1348394 | 60 | 73 |
| 1348395 | 57 | 69 |
| 1348396 | 37 | 47 |
| 1348397 | 41 | 43 |

TABLE 93

Reduction of human SCN2A RNA in transgenic mice

| Compound ID | SCN2A RNA (% control) | |
|---|---|---|
| | CORTEX | SPINAL CORD |
| PBS | 100 | 100 |
| 1348399 | 86 | 63 |
| 1348424 | 76 | 67 |
| 1348425 | 90 | 89 |
| 1348426 | 72 | 64 |
| 1348427 | 36 | 38 |

TABLE 93-continued

Reduction of human SCN2A RNA in transgenic mice

| Compound ID | SCN2A RNA (% control) | |
|---|---|---|
| | CORTEX | SPINAL CORD |
| 1348428 | 63 | 46 |
| 1348429 | 68 | 73 |
| 1348430 | 76 | 79 |
| 1348433 | 49 | 60 |
| 1348434 | 66 | 68 |
| 1348435 | 50 | 47 |
| 1348436 | 60 | 60 |
| 1348437 | 78 | 72 |
| 1348438 | 50 | 52 |
| 1348448 | 67 | 73 |
| 1348449 | 50 | 53 |
| 1348450 | 54 | 46 |
| 1348451 | 54 | 64 |
| 1348453 | 75 | 74 |
| 1348455 | 75 | 69 |
| 1348456 | 42 | 38 |
| 1348917 | 60 | 61 |
| 1348918 | 83 | 81 |
| 1348919 | 74 | 70 |
| 1348920 | 47 | 55 |
| 1348922 | 34 | 31 |
| 1348923 | 29 | 36 |
| 1348924 | 45 | 51 |
| 1348925 | 57 | 53 |
| 1348926 | 86 | 78 |
| 1348927 | 46 | 48 |
| 1348928 | 30 | 38 |
| 1348929 | 48 | 54 |
| 1348930 | 85 | 92 |
| 1348931 | 20 | 35 |
| 1348932 | 56 | 48 |
| 1348933 | 71 | 78 |
| 1348934 | 12 | 23 |
| 1348935 | 42 | 40 |
| 1348936 | 28 | 35 |
| 1348937 | 11 | 26 |
| 1348938 | 29 | 37 |
| 1348939 | 20 | 25 |
| 1348315 | 59 | 72 |
| 1348403 | 88 | 96 |
| 1348404 | 50 | 57 |
| 1348405 | 55 | 70 |
| 1348406 | 71 | 70 |
| 1348407 | 50 | 53 |
| 1348408 | 91 | 111 |
| 1348410 | 38 | 54 |
| 1348411 | 27 | 42 |
| 1348412 | 56 | 62 |
| 1348413 | 56 | 70 |
| 1348414 | 91 | 98 |
| 1348415 | 93 | 104 |
| 1348416 | 95 | 107 |
| 1348417 | 30 | 52 |
| 1348418 | 67 | 77 |
| 1348419 | 47 | 49 |
| 1348420 | 38 | 49 |
| 1348421 | 26 | 33 |
| 1348422 | 38 | 48 |
| 1348423 | 22 | 37 |
| 1348439 | 12 | 16 |
| 1348440 | 12 | 25 |
| 1348441 | 36 | 54 |
| 1348442 | 8 | 20 |
| 1348443 | 21 | 32 |
| 1348444 | 10 | 26 |
| 1348445 | 53 | 80 |
| 1348446 | 17 | 39 |
| 1348447 | 14 | 27 |

Example 9: Potency of Modified Oligonucleotides Complementary to Human SCN2A RNA in Transgenic Mice Modified oligonucleotides described above were tested in human SCN2A transgenic mice (described herein above).

Treatment

Human SCN2A transgenic mice were divided into groups of 4 mice each. Each mouse received a single ICV bolus of modified oligonucleotide at the doses indicated in tables below. A group of 8 mice received PBS as a negative control.

RNA Analysis

Two weeks post treatment, mice were sacrificed, and RNA was extracted from the cortex and spinal cord for quantitative real-time RTPCR analysis of RNA expression of SCN2A using primer probe set RTS36041 (described herein in Example 1). Results are presented as percent human SCN2A RNA relative to the amount in PBS treated animals, normalized to mouse GAPDH RNA. Mouse GAPDH was amplified using primer probe set mGapdh_LTS00102 (described herein above). The half maximal effective dose ($ED_{50}$) of each modified oligonucleotide was calculated using GraphPad Prism 7 software (GraphPad Software, San Diego. CA). $ED_{50}$ values were calculated from dose and individual animal SCN2A RNA levels using custom equation Motulsky: Agonist vs response—Variable slope (four parameters) Y=Bottom+(Top−Bottom)/(1+(10^log EC50/X)^HillSlope), with the following constraints: bottom>lowest value in data set in order to compare across ASOs (4.5 and 9.4 for cortex and spinal cord, respectively), top=100, HillSlope<−1 and >−2.

As shown in the table below, treatment with modified oligonucleotides resulted in dose-responsive reduction of SCN2A RNA in comparison to the PBS control.

TABLE 94

Reduction of human SCN2A RNA in transgenic mice

| Compound ID | Dose (µg) | SCN2A RNA (% control) | | $ED_{50}$ (µg) | |
|---|---|---|---|---|---|
| | | CORTEX | SPINAL CORD | CORTEX | SPINAL CORD |
| PBS | N/A | 100 | 100 | N/A | N/A |
| 1348259 | 3 | 96 | 83 | 86 | 26 |
| | 10 | 94 | 84 | | |
| | 30 | 82 | 47 | | |
| | 100 | 49 | 27 | | |
| | 300 | 17 | 17 | | |
| | 700 | 8 | 16 | | |
| 1348271 | 3 | 115 | 95 | 191 | 93 |
| | 10 | 99 | 90 | | |
| | 30 | 98 | 75 | | |
| | 100 | 72 | 51 | | |
| | 300 | 36 | 36 | | |
| | 700 | 21 | 25 | | |
| 1348289 | 3 | 106 | 86 | 57 | 21 |
| | 10 | 98 | 71 | | |
| | 30 | 77 | 44 | | |
| | 100 | 31 | 32 | | |
| | 300 | 7 | 13 | | |
| | 700 | 5 | 11 | | |
| 1348290 | 3 | 99 | 93 | 63 | 29 |
| | 10 | 81 | 72 | | |
| | 30 | 76 | 52 | | |
| | 100 | 44 | 33 | | |
| | 300 | 10 | 25 | | |
| | 700 | 9 | 14 | | |
| 1348331 | 3 | 106 | 95 | 36 | 28 |
| | 10 | 73 | 78 | | |
| | 30 | 55 | 50 | | |
| | 100 | 34 | 27 | | |

TABLE 94-continued

Reduction of human SCN2A RNA in transgenic mice

| Compound ID | Dose (µg) | SCN2A RNA (% control) CORTEX | SCN2A RNA (% control) SPINAL CORD | ED$_{50}$ (µg) CORTEX | ED$_{50}$ (µg) SPINAL CORD |
|---|---|---|---|---|---|
|  | 300 | 11 | 21 |  |  |
|  | 700 | 7 | 16 |  |  |
| 1348347 | 3 | 90 | 94 | 88 | 40 |
|  | 10 | 100 | 92 |  |  |
|  | 30 | 84 | 60 |  |  |
|  | 100 | 49 | 31 |  |  |
|  | 300 | 14 | 19 |  |  |
|  | 700 | 9 | 17 |  |  |
| 1348383 | 3 | 118 | 103 | 186 | 49 |
|  | 10 | 109 | 81 |  |  |
|  | 30 | 84 | 63 |  |  |
|  | 100 | 70 | 39 |  |  |
|  | 300 | 41 | 23 |  |  |
|  | 700 | 18 | 20 |  |  |
| 1348385 | 3 | 121 | 93 | 123 | 86 |
|  | 10 | 95 | 75 |  |  |
|  | 30 | 86 | 73 |  |  |
|  | 100 | 62 | 34 |  |  |
|  | 300 | 21 | 20 |  |  |
|  | 700 | 13 | 14 |  |  |
| 1348439 | 3 | 103 | 110 | 137 | 70 |
|  | 10 | 97 | 106 |  |  |
|  | 30 | 96 | 70 |  |  |
|  | 100 | 70 | 41 |  |  |
|  | 300 | 19 | 25 |  |  |
|  | 700 | 11 | 20 |  |  |
| 1348440 | 3 | 124 | 104 | 158 | 60 |
|  | 10 | 105 | 73 |  |  |
|  | 30 | 109 | 95 |  |  |
|  | 100 | 77 | 38 |  |  |
|  | 300 | 18 | 20 |  |  |
|  | 700 | 13 | 16 |  |  |
| 1348934 | 3 | 116 | 108 | 56 | 33 |
|  | 10 | 95 | 92 |  |  |
|  | 30 | 72 | 56 |  |  |
|  | 100 | 31 | 30 |  |  |
|  | 300 | 10 | 22 |  |  |
|  | 700 | 12 | 19 |  |  |
| 1348937 | 3 | 125 | 94 | 73 | 34 |
|  | 10 | 109 | 81 |  |  |
|  | 30 | 73 | 57 |  |  |
|  | 100 | 41 | 43 |  |  |
|  | 300 | 15 | 28 |  |  |
|  | 700 | 9 | 18 |  |  |

SEQUENCE LISTING (2540 sequences)

SEQ ID NO: 1 - DNA, 8776 bp, Homo sapiens
  source 1..8776: mol_type = genomic DNA
aacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaaca

SEQ ID NO: 2 - DNA, 268000 bp, Homo sapiens
  source 1..268000: mol_type = genomic DNA
ttttttaaagaacataatgtagttgagagtgtaatgtactaaataacatctcttttttggaaggctacttttttttgagatagggtcttgctttgtcactcagggttgagtagaatgatgtgatcgtggctcactgcagcctctacctactgggcttaagcaatcctcccacctcagcctcctttgtagctgggactacaggcatgtgccaccatgcccagtgaattttcgtatttttttttgtagagaggagattttgccatcttgcccaggctggcctcgaactcctgggctcaagtgatctgcctccttggcctcccaaagtgctgggattacaggcatgagccaccatgcccagcctaaaaggccacattttttaaccacattttcaaatgatcaagaaaatgaatatactaaagactcagaatggtttaatttcctgtgaaaaattggaatttttagaaatccatttcccaataaagagtatcttgtgattttccaacatcactatagacatatgactttcaatattgctttttgataatgcatataagcacaatgaaaatagtaaataactgtagtacatggttatcataggaaatggaacaaaaaatttaaaagcattcttacctctttgctttcttctagttctgactcactgctgaactcttcagtatttaagttttcaaagtcagactctccaacagcaattggcactgtgacggtgaggctggggttgtttatgaatgacatataatcattttcatcgattacgtatttttcaacactgcttccagtacctacaccactggtggttccattcccatctctaagataattaagctctttgcttatttcaattccagtattattggacatgcagctgtctatcttattgccttcatggatttctataacttttggctttctaaaaaaggctttttggaaacactcccgcatcttatttttcacataatcaattcccttttgcattcttcctactgcaatctgcagattattcatttcattgtcatcatcagtagcagcaaggttgtctgagctaaatgaactcaacaataaggccagaaagaggttcagaacctaaaagaaaaaaagaaaaatgtctattttaatattgaaatatgcatttaaataacagcctaaaaagggaactcatagatctttgctaaaattatttcaacaaatgtttattgaatgcttactatatttcagatgccatgtctaagtcacacactctttaaaggacctaatatcctgctctaagggcaaaatgataaaacaagcacctcttctttttttcctattgggagggacaataggaaagcagagcttctaagatttaaatggtgtctactcaggtttgccagtgcaaagacaaaatcctaccctcaaggattctgccaacgagagagagagagagagagagagaaagatactttcttcttaatcattttatcttacttcatcttaccattttttttcctagggaatttctagcttcgtgtatataaagaatgaacttatttatttaatagcctgatgatatgttccaaatgatatacttgaaatacaaattcctttggcccaatggccacaaacttttataacagcagaaatttctaagtgcaaattatatacgatttaacacgtttcccatcaaatacactttgaaatttatatgttcaaatagctcaacagatggagagaaatctaaaagtataccagggtttaggctagacccacataagttacttttctttttctttctttctttgtgtgtatgtgtgtgtgtgtgtgtagaaagtatgaggcgattttaactttcagaatatcatgggatatgtgaaaaagttactcagccaactgataagttatggttaatgcaggaataattcattatttctgatgtaaaagaaaatttataataatatttttagcctgaaatgtagttagttattgagtttcagaatatgttacactataggaagacatgcaaggcaaaagccccagtttgcttccttacttctgtatcagattttttcagaatctagagctccctaatttactattctggagaaaaaaattacatgttcgtaggtatcccagtagcattcttttgaacaagtttatctgaaatgtatccctcaaaggaaaggcccaatatgatggcataaagaaatgctttgcccacgcatgactgagaaatttaagcattaaacatataaatatataaactatgcttttgcattagtgattttaagtcacagttaaaagtaactcctttgagtctggacaatgtccatacatatgaataatttaaactgtaataattggttttcctatagtaatgcaaattcagggaagaaaacattttgtcctcttccaagttacttggataattacaatgcatagctaaaatataatggtctacttcattgaaatgtgtcttcaaaatttggtactatgcaacctatgtctctaagtaagcaaactacatgaactatgaacatgcaaagagcaatttgattatagaatagatagttgtctttttagatttagtagaggtcattttcttatcaaaacaatattaggatacaattcttcttagtgataaaaatttactttctttgaagaagaaaggaaaatctaatatttatgcccccaggcattcataaatacatctgatttaatctttgcattaaagatatgatttcagttttattattccaatgtcataaaaaatgggaaaccagagcccaggagaagttaaataacttgcttattctctgagtgctaatagggggatttcagtctaggccacttactataaaccagagatatgtttactacatctggccacgttcctagctactgtctgctcttgttctaatttatgagcatttgtactacatacataccacaaggtttccaatgaccatgaccaacatgaaaacaataaggcacatggtttggccagcgacctccatacagtcccacatggtctctatccactctccacacagcacgcggaacacaatcaggaaggagtggaagaagtcgttcatgtgccaccgtgggagcgtacagtcatcattgatcttgcagacacattctttgtagctcttaccaaagagctgcatgccgaccacagcaaaaatgaagacgatgatggccaacaccaaggtgaggtttcctagagcccccacagaattgccaatgatcttaattagcatatttagtgtgggccaggattttgccaacttgaaaactctaagctgtaatcaagtgaaaagatgctgttagtagtaatcataatataattttagacattattttattagtatgtggtatcatagaaccacacgtggtagatgtaaaaactcaaaatatactgaactgattcaatttcaaatccagaaaaaatagtgttaacaatattagaattgtaaatctggtcataatatcatttaagtgcaaaaataaaaataaaacatttcagaaataataaataaaacatttctgattcatccaaagatatgcccatgtaaacaaatggtattttgattagagactttttaaattagcaaataaatgttatcttcagattctattttagacagtaaaaagaaatattaaaagtataaatcatagatttttataggccaatataaaagtaaaataacctaaataatgtgataaaaatgtacaggaaaaaaattgaaaaaatacacattttgcttaattttcaataaattttacatatttctcaataaaattttgtgataattcaaaaagttttttatacaattatttaagatactaataacatcaaatattttcccacatgttgctttaaaacagtccccattcctagaagtagggttaataaaaagctaaaattaactggggtctaaatttttatttgcgtatctttacagactgtaaggccaaaaaagcttcataaacttaaaacacagttttagaaagtacttgtaggttttctaatgtgccctacatacctaatcattatagagtattttgaatgctttcatcattcttagaaaatggtttagctttaaagaggatgtttacatgttttcttagaatgtcacatattgatgtaaatttaaaattaaaattaataattatataaatatacattgattcaatttcaaaataaatgttgtgccaatgagcgacagggatatatataaatagataccagtctgaatgatcgcagtacagacaatccctccacatttgacagaccaagctccattaaactgaggctgacaataattccatcaaagatattccagccttcttggaaatagtaataaggatccatggcaatgatcttgagaaccatttctgctgtgaaaatcccagtaaagacctaaaaaatagagatcagcactacttcaagagcactgaaaaacactgatgctacacgaatttataaagaagaacattaacaggaataaaaatatctaaaatttaaagtgagagaatgtgacaaatcaattcaagtcttagtttttttattttcattttttatttttatttatttttatttattttattttattattattatactttaagtttgagggtacatgtgtacaatgtgcaggttagttacatatgtatacctgtgccatgctggtgtgctgcacccattaactcgtcatttagcattaggtatatctcctaatgctatccctcccccctcccccgaccccacaacagtccccagagtgtgatgttccccttcctgtgtccatgtgttctcattattcaattcccacttatgagtgagaacatgtggtgtttggttttttgtctttgtgatagtttactgagaatgatgatttccaatttcatccatgttcctccaaaggacatgaactcatcattttttatggctgcatagtattccatggtgtatatgtgccacattttcttaatccagtctatcattgttggacatttgggttggttccaagtaattgcttcaaagagaataaaatacctaggagtccaacttacaagggacgtgaaggacctcttcaaggagaactacaaaccactgctcaatgaaataaaagaggatacaaacaaatggaagaacattcgatgttcatgggtaggaagaatcaatatcgtgaaaatggccatactgcccaaggtaatttatagattcaatggcatccccatcaagctaccaatgactttcttcacagaattggaaaaaactactttaaagttcatatggaaccaaaaaagagcctgcatcgcccagtcaatcctaagccaaaagaacaaagctggaggcatcacactacctgacttcaaactatactacaaggctacagtaaccaaaacagcatggtacttgtaccaaaacagagatatagatcaatggaacagaacagagccctcagaaataatgccacgtatctacaactgtctaatctttgacaaatctgagaaaaacaagcaatgggaaaaggattccctatttaataaatggtgctgggaaaactggctagccatatgtagaaagctgaaactggatcccttccttacaccttatacaaaaattaattcaagatggattaaagacttaaaagttagacctaaagccataaaaaccctagaagaaaacctaggcattaccattcaggacataggcatgggcaaggacttcacgtctaaaacaccaaaagcaatggcgacaaaagccaaaattgacaaatgggatctaattaaactaaagagcttctgcacagcaaaagatactaccgtcagagtgaacaggcaacctacaaaatgggaggaaattttcgcaacctactcatctgacaaagggctaatatccagaatctacaatgaactcaaacaaatttacaagaaaaaaacaaacaaccccatcaacaagtgggtgaaagacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagttaggaaacaacaggtgctggagaggatgtggagaaataggaacacttttacactgtttgtgggactgtaaactagttcaaccaatgtggaagtcagtgtggcgattcctcagggatctagaactagaaataccatttgacccagccatcccattactgggtatatacccaaaggactataaatcatgctgctataaagacacatgcacacgtatgtttattttcattttttatttttattatttttttttgagacagagtctccctctgttgcccagattggagtagagtggcgcgatcttggctcactgcttcaagtgattctccagtctcagcctcccaggtagctgggattacaggcatgggctacctaccatgcccagctaatttttctaatttctgtagagacagggtttcacatcacgttggccaggccagtttcgaactcctgacctcaagtgatctgcccgcctcagcctcccaaagtactgggattacaagcatgagccaacacacccagccatgtctagcttttttttttttttcctctaggagagtattttattaagtagagtggtattatttaatgaatcttctggatttccaagaaaaacactaattttaaaacatttcatggtctacattttaactctggtattgaataatagctactgaattattgcccttgttggtacactacatttctaacataatcacaaccaaatttatttctgggtagtatcgcatcaggaacaaatccacatattactgaaagttattaaaaattgatttcgtaaaaaccatattttgtttttgattttgtgttttttaagggacaccatcttatttctataattttataaacattcctgaaacaaaagtaagtttgccacaaattgtttattataatgatctctggatgtatgcctcagaattaaggttaatggattaatagagcaagaagctgcagatttaattgaaaccagcaggagaaaatactcagtatgcatatacatgtaattgagattaataagtcacttgagtggctagataaatgtgtatttgacaatagaaagaaaaacaatgaaacaaacacaacatttattttttaactcaaaacgataggctgagagatacaggacatgaagaattatgaaattactcttgcagaaaatcttttaaagcaattctcttaatttgctatagttacaagttgcagtttatgactgtaaagtcaagtttagcatttacgaagataaatcagcctttatcttgaaggaattctgtcaaaataacagtataacaattatttggttccacttaaaagaaatcttgatccacccttacgaatatataaatgcagctaacacttcattttttccaatcacagatgggaaatacccatcacagaaaaaaacagcctaatggtagtcatccattcactcaaatagaaataaaatgtattttaagcaagcctagtacatgaaaatccaagtatatggtgaaatgcccattgaaaaatatatttttcattttatagaataacacatcaaagatttttttttcaaatagtgagtttgcctggtaaatgtaaaataagttgtaactatacaaattttatttcatgtataaaacttttagaagcagctattatttgaaataggcactctgatgatagaaatatattatttaaggtgagctagaaccatccaggtaaataatctacaaatatctctttctatagaaaatcataaggtgatcttttcagctcttctaaaatgactagatctcatacctttaaaaacatataccctaaatttacgcttatctaaaaatgtaatcccgccataaaacttttcattaaaaataatatttttattacaactagcaatccaaaatgacagctatatctctgtaactgttttcagttaaggccctaaaaatcaatgggattgtttttggtacattttaatctagtttcagcattgtcaggtaagttggaaatgtttgttatgatgttgtctaacctactatgattgataggctattttttgctgattgaatccctatgatgggagcaagcattttataatgattaaaaaacaaaacaaaacaaaatactccacaaaaatacggagcaccttagcaaaacttaattgagattcaaggtctcttgatactcaaatttgattaatctcatcaacaaggaagtgatgtaatttttatgtactgcagaaacagaatgcaaaatggggcatattgatctaagttaagatggaaaattccacaattcagtgtcctcatgtagaacataaagcagtatgcaataatttgagcagtaataaactagtctgtagatattctaaatttattttaatgagcaaattataagctctccacaaaacattctgtgtaatcatctatgatctataatatagtcctaagtcagcttagcaccaatgatagaaattctttctttctctctcacatgctctttctctgcatatatattaaacatatgtattactttcatatggatatttatgataaaggttgttatgggtaggaaattctatgggtagatattctatgaacaaatgctttgtaaattatgcaatgcattattgatatgttaatcattatagtaaggaggtatcaaccaatagagacagtcagtttacatattctcctatttttatggatagaaataaataactcaagtctgttccctataatttatgctctctatcttggcaagttttgtttccccaacactaacctgaacttatagatggttctatcacaaacaatctaccaggcatcagtctcccattccactttcccacctcattatttcagttactacccataaagtcatagaattgtagaactgggacatacataaaaagtcatttagtccaacacactcattgtttatatgtgtgttgagaaaatagactcaaggatctaagtgacttttcaaaaccacacagatatttaccatgaacactttgactaggacctagatttgatgcttttgtctagtgctttttcattcaatcatcttataatccagcctctcttatcctgtgtttccatactcaactgcttcagcattggaattctatatttcctgcttcactctggcaaatttccttcacctgttcaacttccctaactgtccaatatcctgggaaaaatacaagaactacaccagaaatattttccatcattatttcaaagaaaggtctaaaaggttaatagcatatatatgaggaaggaaactgtttattgagcacatgctagatgccaggcacagtctaggtgctttcacattacctcatgtgaccttcacaacaactctgcacgaagggtattattacactcatttcaataatagaaaacaaagattcagattgtttatcagaattgtccagaggccatatcactagtaagcactaggcaactaaggtcaaactcaattccactccactgcaaagtctgtgctcttttgcaaaatcatgctacttgaagcagcctttttgggtagttatcaaccagtgggttatttattgagtgactagcatgtaaacactgagagaggcaacagaaaaatgggacacggcctttgccaaagatgaagaaaatctcaagaatatggtgggtgttctactgagtcaaataatgcagataatttgaggtcacttattagggcacacaattatccaattgtccaccagcatttcctttcccccttctgttggcaattgctccttcacgcatgattcctcaggactgccatgttttcaacatgatcccaccctctgccaaggctgattaaatcagaggtgagcatgtgacctaaattatgcctaagttctaccaggagagtctttggaatgagactcaaaaggagattcatgcttttcagtgtagaggttgtaggatggaaaatcagtgagctcttgctgaacatttgctgacctaaagacaaatgatgcagtgaacttgtgggccatatctaagcccttgatgaaaactgttcctaaagtcagactgcaatactgccctttacttagtttgttagtctaccttttccctccattccagtttccccactaccccttgccccaagtttgttttagtacagagaaagctcttgattaataatatatgtaaacccttttcttacttgttcacccattttgattagcacacatagacacagatgaatgctcagtaatttgaaccagaggtatggctaaatcacaaatgcaaatttagcaactattttttttcttgtatgattatcactgaagctttttattaggtagttaacttgaaacaatgatgttctttttttcatatacatcaatctttgggtcatcccttcaatggacatgattgttttagaggctgtgtgggttaaaaccacatgattgtggagccagtattagatctcctggtttatctggacccacatttccagcaagaacaactgtaaagattttgagacgtttacaactggtaagacaccatgatcaatcagcacagacattggcctaaacaatcagcattcataccagttgagttttaggctgtatctctgagattccctgtaatattccttagatatttctttctatgaggaaagaggatataatttttgggttcaacacagcacaaatacatctttccctttggtctatctctcccacatctaccaaagtaaataagtaaacttcaaatgtacttaccaggtttcctacagtcaacacactactgaattgctcagtcatggggtagtgctccatggccataaagagggtatttaagacaatgcaaatagtgatggcaagatcaacaaatggatccataacaattaaattcacaagatgttttacttttaaccatgcatcacagcagtcccagatcaagaacacattggcaaatctataccagcatggcggacatttctgtctagattcttcaagttctggagggacaataacaaggaagagtagtaaataacaacaaaaatgagttattattgctagtagattttacattatttaacaaaattgatgcttatatttgaaaatagaagttcatattacttaagaaacttgagaagacaatcccattaaatattttcagaaaatgttaattaaaatgtcatatagatcgacttttttctcttttgaatacagaaaataagcactttgaatttaatattttgcttttaaaatgactaggttatgattgattaaagtgctgtattctctttgtcaaaacagaattttaaataaacattacacaactattaaaattttaaataattattgtttcttctgaaagtacctttttaaaaacattgtctaaagttgtgatcccttatgtgtgtgataacatttatgaactattctctcctctcatagtttccatatcaacattaatcttgcacacagtgagaacgtagtatgcctttctttttagtataaattcagactcaaatctacttttgtggtttgtacatatcttttagaattttagcatcatgtatttaaaatattgcttgaaattttaatggatgaggcctgttacaaaataattattatgtgactgtatatctaatacaccaagaagacatgatataaaatgtaattgatgttttctaaagaacatatgttagaattgacatataattgatctaaaaagggcagtactaatatattctctctccagacttcaaggagtgagggctgtgtgatgtatgaacaagtttagtgtataaatagttgctgcctattcctctgtgtcaaaatcaacaaacatttctttccgtggtcctttggaggaatgtaatggttgctgtgtatgtagaagatggaagagagacccttttgtaggatctctcttgcagtggaggacaggttttgatttgcccaactcatttaagtgctcccgcaaccccatcaacacttccatgcctgaagaacagactaaagcctgaaagaaatgtttccttatgcttctatataccaagacttagaaaaggggaagagtttactctatttgcatatgagtaacataacataagaataaatcctcattgatataatatcaagtgttgaaatatcactctgcaagtaaggtaaggacccaagtcaaaaagaaataaggccaatattagtttttgtaatcaatgtgataatgtactccatatatcacattcttaggtctaatatatagtttcgatctgggtaacagacttcagtaattctatgaaaagaaggaatagttcacaaagcacataatcacagaaagttggctgttccatgacctgcttcttaccttccattgtgttggtcagaatgctggctatgctcacggctctttgccttccagaggaatcctccagcatctccattgaaatctggtaagagcttaaccttctctttctgacttccgtttctgtggtggtgccctgcaaaccaaatactgatggctcaaaccactcttcccaataagtaatacaacaccacatagcatttctttggcaaatcatgctacatgcaatttttccaggtaagaattttcaaggaataaaatattgaattattgctaagttataaacagttttttttttaaaaaaaagttatcacaggtagtactctttaagaggaattcaccagtgggatgcagttttataacacaattatattacagaactattttaattaacctgtcacaattttcaaggaaatttgttgtaaacatgctaaagtcatttattattttatttcattcaggtgaaaattatttttatcttctatcaatgattaataatcagatcaatctccccccaataaatattatgattatatagtctcaaggctgaattattttctttgaggctatattgacaatattgacatatgtgggccaattttttccatgcacaaacacagatgtacgatgaaatgtgtgtgctttcctgaaatttctttaattatttctatatcttatcctattaaaaaacaacacattttagagtcattttaaaatagcactgtaaatattgacagttgtatgaaattgcccattatcaacaaattggttataatatttaattttaagaatatgaattttccagaatatgaatagataattatacaattcttggtgaatatacatcttatagatttgatggtgaaaatgtccattatttgtctcggtaggtctaccaaatttgcagatatgtatttcatagcagactctaaaaacggggcccttttaacctaaagccatggtcccttacaagtaattcccatacaacaaaagctaatggtcccatacaattcaattgattctcaatattctattgttttccctttgattaatcatgtattatttttaccaactttcattttgaggaagcaggacggtatgacagcctaaactgtccaggctttgattatttcaaattggtgaataatgtcagtagcagctaggtcatctattatcacctctgggggaagttgtccagtaggtgacgttagagctgaaggtccacccaccaaggaaaccacaccattgcaatccacagtgctgtgcatcttcccatttgctggaagccctggcaccatcctggatgacatactggcctgactaacgttactgttgcgtcgctctccatgtctgtgcggcacaaacagtgagtctctcctgctttcgctgtcttcaaatgtgctgtgttcatcatcagcaaagtcattttcagatccaacatcctttgcccgacctctgaaactgaaaatgcttgttttgctattgcgtcttggggaaaacagggagccacggatactcaagagagactgcagagaaagcaaaaaggaaaggaatgggatgggggtaggggaagaacgcaattatttaataaatattaatattaaaggatctgttttctttggagttagtatactcttgctcttaaacatggataatcaaatttatagaggacacatatattttgatatttttattaaagcaaatttaagtacaaagagtgtttttctgactaacaatactgatttgcaatttactaagtatacaaccacttcatttagtcttcactttaggtggattgggttatcataatgctataggttagggaccagatgctgaaaaggataaatgatttcttttgatgggaatggtggttaaacaaatagtaagtagcttctacttcttaatgctataatctgaagggaatgtagcctggagaataagttttggctcaagtgagaatgttagctcaaatttaaaatatttgtttcaaatgttgcattgtagccaatatttcacttcaggataattacttttttaaaaaactactatttttccattctcttcttttgaattctgaaagaaaagtagtttactctttctctgaaactgtttgtctctacccacatgggaacagaagtcacaaaacttacctacgatgttgtcttccaaatttgctaacagtttcccaaatggcaaccaatgattcaccttatttgagagactatatgtcatagcaaacacaacacagaggattcctaaactgctacacaaattactcttcttgtgtaaaatataacactggcttgtaaaagcaagacatataacatgacttcaccagcaggtggtgtgaaaaacaacatatacttctgttttattttaattatattaaaaagaaagagacaattcaaaacctttttcattacagctattcccagataaattaagcaaactatttcctagtaccagaaaatgaggatttagcttgaagttccttctttcacattttgaaaggattttaaactagcaaccccaaataattctgtgtgtattcttgtcttgcagatagttttcaaaaacatctctattcagtctgcagaatatttgttttctcccctcatcatgaacaatggcattcctccttgctctctcattccctttcctacttctcttcacacccagggtaatatacatacatacatatacatatacatatgtcagcagcaaacattcctggatcttctctttcttctaagctttagtgtaaaaccaaataaaatgattttagtggaaaaaacagaaaaggcagactctgtcaaatgtattcttggttcctctgcctaattaggtcatgctgattttcttaggccccaatttttagctttattttcatggcttttcccagactgcaaagcaccagaataatctttgttgtcctctgtctcagtgatattctggaaggatattattcactaagaagtgctctgttcctttggatttggttagattctccacaggaactattggctgtccagcttgtccatcggaggctgtgtctatgtgacactcaattcctgtagcaggtttgtctaccgaagggcagacaatagagtgattttacagcaaagtgatcaagagattagatcatgtgaagacatcaattcatccccccattaataaagaatgctaatgtttttcatttcctcagactccatttaaatgatcaatataataacagttatatccagaactcgtgttgttgttgttgttgttgttgttgttgttgttgttgttgttttgaggcagagtttcgctctgtcgcccaggctggagtgcagtggtacaatctcggctcactgcaatctccacctcccaagttcaagctattctcctgccttaccctcctgagttggctgggactagaggtgcccgccaccacacctggctaagttttgcatttttaatagagacagggtttcaccatgatggtcaagctggcctcgaactcccaacctcaggtgatctgcccgccctggcctcccaaagccctgagattacaggcatgagccaccatgcccagcccagaactagtgttttgaaacatttgagtgtatgtgaatcactctgagagttaaaaatatatatttttaggtcccagattttggaatatggattcaggaagtagcagataggactctggaatctgaattttcctgacacattccaggtgaccctaacacagggtggacctcatcctacactcagagaaatactaacttggtcttacattaatccctaggatggctgagtataatcacctcaatacacctatgttctgaaactgtctctggaaactgaaaatcggtctacacagtattggttgggagtatgtggtacgtgtgtacatccactatgtatctgggacatgcctttaatttggatatttttatgtcaggtattttcaaaggcgttccagatctctgagtttatttgaaatttctattcactctttggaatgtataataatgggtgtgagcgcagctttcaaggcaacagagacggaaaaagaagataacagaaatagcattcagagaaaataaaccaaaaataacacactagaagatgcagcagagtggagggaatacccacagctgtggcaacactttctctagggaaaaccagctttaatgttttaaggagtgaaaggccatctttctttacctcaggcatgtcaaaacatatttcccaggtatctttttcatcttgttcccagaagataaatgtagactgtttcttaattttcagtaacaaaagggaaaatagaagaaattaggtctataagacacagtcatgcatgtagggtttggattcaaagtgggttgggaaaagtcaagatggaaaaagatgctgggaattttaagatgttctagtgggaacaaggaaagtgaatatttgtcagaagtacttagcattttgaggtttcattttatacttttaagtatttctttattttgtacaactaacattatctgtttaaaaataaaataatgtaataaacataaaataacatttgtaatttatgtgaatagaaggcagggcacccacaatttatgccctctctgctttgacattttcagaagatacatttgatttgagcagtatttactgtctatcttacgcttcctgtccccaccaccttcactgattctctttctaccagattccttttttgtttacagaagcagaaattgtaaaccgtttatggtacatttctgcttgttagttttgttaatgctcttagtctgtctttactgggatatgcaaatttaaaactaatagattatttccttcacttttgaaattatccatctatcttctgtctatttacaaatataaaatgagcgacatctaccacatgtatgtactgattctgcttttagtattaaaacactggccatcagctaagctctctgctcttgcctgtctgtggttcactcagctccagcaaaccaagtctaccagttgcttcttaagcactccaggcatgctaccatgtcagggttttgcacttcctctttcatcagtttagaatgctgttccttaagagagcctctttctttgcctcctccaaatctttcccaaaatgtcttaatagtgaggtcattgtaaaccaccctatttaaaattttacctccaattatggctcctgttcctcttttcctgcttacttttttttcccttaacatttgttaccttctaacacagtctataacttatttattttattcattgtccgtctcctttggaaaaaatttccatgaggtcagtggattgagtctcttttattctttgaggtattttcagcatcttgaactatgcttgctacatagttggcgatcaataaatatttgttgattggactgaatgaactgatctacaaaatttatttgagcaaaatgatgaaacaataaaggaactaatactgctatcaaattatgtatatacatttgttagtaattgaaactactcagaagtttgctttccctcacttgaaattcattcaccgattttaacttaataagagacttactctttgtcacacagattttctatatattgcttagtcccctaaatctctttaatgtaggtattcttactttattttacagaaattttacaaagtacaagtgacttgaccaacgtcacagaactagtttggagttgagatatgaacacaaaagtttgtgttcactgtagcatcattatgctatagtttcatatactcttaattctaataactcctaatagttttaagaattccaaaatatcaaaggtgactgtttaagaaaaaaaaatctgatctgaggaaccaagttgcccttcagagcttcaagttaattccaaatatgttatactgatttgataatatattttatatttgtattacacaagatagtaatagttgaatttcttgatattgatgttatctgcagaaaaatggctttatcttaaaactctttgtgtattcatgtccattttgttctaatatgagaatacaagttttaagttattaatatagtctacttttttctttaaaaatatttgtttacatattaaagatagattataaaacattcactgagaacttgcatattaccttttctcccaaccaaaagtaaatactatgttgaattttgtgtttattacttctggttttttttagaagtttctttctttatgaaaaatatatcataccccttggttgatttgcagtttttgattaaattaatcttatatattatctctcaaagcattatttttagggtataattctgactcaagattgttatgattagaagcatttgcaattcatagcacatgaaattctaatggtgccaaatagtgttcaaagccaaaattgtacttatcacagattttgtaactaattattctttacatcagacatatgtaaacaatacattaacttactaatccataaaacttactaaacatcaaataattgaaactagtttttactcttttacttaaaactatgctgaagaaccaggtagttggcattaaatcagagcaaaaatagactacctttgatgctgttctcttcaagaacatttaggtcataatttcattctaatgtatcacggcatgaccctatgcaagcaaaatggagactcaccatagtccagttctcttaatcaaaggataaagacaaaacccaaagaacacttcttttcaaaatttatatgtatgttacgatcacaactttggataacaaaggcagaaacccattctcaaagaaaataagtttatctggggtctcaaaatggaaaatgtaaacaagagattccaaaactctcattgaaaagtctgctagtgtaggttatatatatatatatgtgtgtgtgtgtgtgtgtgtgtgtgtgtgtgtgtgtatagacacatatatacacacatatatatatacaggttgatatataggttatatcaatatatattatatatatctatatattatatcaatatatctatctgtatatataatcagtctcaaaatggtgaacattttattaatggtttaataaaaatccctttgaagacaatctattataagaatttaaacaactatattaaatgttagttccctgtccctcactgaagtcagatagtacaaaagtgtaccaaaacaaaatacaaaaactaaaaagcaatagcaatgacaaagaaaccagagcacttagtagaaaatcatacctgatgaggggagcagaattttttgtcactggtcagtctgtttccatccatggagaaaaggaagctgcttcttttgacgctgtcttcagattcggatttgggaaagctgtctctctctcctttgttgtttccttcaaggtgctctctctgtcttcttttcttccttcggttcctccattctttagcacttttggaactcaactttgatgcttctgaagaactttccaacagctctcctaacccacctattccactgaaatctcttgaagcagctgatgctgccgcaactgcctgtcataaaacaaagccaggcactatttagaacacagagctttgaaaacagttgagtatggttaaaatattgccatttaagactcattaactacaagtgaaaagtctatcctctagtccttttattttgtctcaccacaagagtttacttaacaatgacccttatgttttaaatcatataaagcaatatgctagtgtatgcattaaagcaagaaaaatctggttttgcctatcttctggattgtcttttttttggggggggggggttggtgacaactgttctcttcaaagtgtcttctatactttaaaaagcaaatgttttcttcgtggtggttgcttatctaactaccattctgattccatctgtaaaacgtttcctcctgtgtgcacttctgagcagctgagtcgtattttttcccctctaaatccagtacaaaagactgtttcttttattttttgtgaacataaaacatttcaagtgtctactattttacctccagatggaagtagggaaatgtattagatagcttatcctcttccttcctttgaattacatttaggactgtagttcacatctctgtgatcatgttactcccagagaatttattacatatcacttaaaaaatgttaaacgttcatagattatttaatattataaataacaaatgattaacatagcattacataaattcattcaaaggattatgagaactgcttcaaatattttctttctatattgcagcactaagtattcttaagcactttgaatttctgtacctacaaatgaaacacagtcagctctgaggtgaaacatggcaaatagtatttttagactggaaatgatctaacaatgacatacagaggatatgaaacaatatggtgtgcatcaaagctgagttctcattaagtatattactatttgtaaatgtaaccacagaagtgaaaataattaaattatgacaatatcagttaaactttttacatatgtcatcactaaatacaaacaaatctaacttatctaatatattatctttcccattaactgtaagctagatagaaattgtatcattgtatgctcagtgactagtatgtcacctgacataaataaggctcagtaaataattggtgaataaagatttaaaaatgtactttgctatcaattgtctcagacactggggtgggggtgggggaagaacaagacatacttaaccttgactttgatgcttctgaagaactttatagaacttatatttaacttgctacagatagcaagttgacttttcaagacatcataaaagacttgacttttcaagacatcataaaagactgtcataacagtctatataacaacatattttaggaagaaatggagataaaacctatttataatgctttgacaacactttgtgctttatgtttcatctttcttgagaagaagcaaactctcctaagtagttttcatttttaaacttcatgtttaaaaatttaaaaaagattttaaatctaaaattactatgctgcaaattctctaggattacaatgatctcagggagggaaacttagtactaaatatgattttaaatttatgtgtttgaccaagcaacacataaaatgtaacatatttatttatattaagcactatattcataatggaagctcaaatctaagacttgatataagacaatacccagcatttaaataaaacagtaattcagaatttagatatttataaaattttatagagtcatatagccaggtttttaatggaattattgatcatcagtatcacttttaatataattcatgatgtaaaatgagaaatattaagtacattttataactctgactatatatgcaaaataaagtgaataaatgaatcacttatctatagcaagttaaatatagttacagagttctggatacatatgaggtacataatatacaccatttgttgaaacagtgaatatatatataccctttcttatccaaataaagtccttaattctcttttctattttatatagacacaaacacacaacacacagtgttaatcatttattgacttgtttgtccctgcaaacaaaggaagtggtggtaatagtcccttaccataatcctacaacttatgtccatttaaatcacttccaaactttttttttttttttagatggggtctcactctgtcgcccaggctggagtgcaatggcatgatctcggctcactgcaacctccacccccgggttcaagtgattctcctgcctcagccccctgagtagctaggattacaggcgtgagccaccacacctggctaatttttgtatttttagtagagacagggtttcactatgttggccaggctgatctcaaactcctggcctcaagtgacccacccacctcagcctcccaaagtgctgggattacaggcgcgagccaccgcacccggccacaaactttgttttgcataagacattatttccaaacctattctgggtaacagttcaaataactcaaaaccaaaacagatttctaaggcaacaaaggtaacctcagacacattttctgtgtcactcatcaactcaaatctgtcatttgttccacttccagtgatttgccagttccctcaaaggcagatgtttcctgtcatctctcatgtctgtgtacctgtttatacccaactctgtgacactaccaatgtcctgcgtatgagaataactgtgttactttcacagccaacttgctgaattcctcttttaacaaataagaaatttcacttaatatttactcaggaaattacattttcttataacatttttgtgtgattcaaagtaggctctgtaactcactgtatctgtgtgtccgtaaaaatataaccacataactaatactttgttcattttatgtatataatccagttaaaatcccattcaaagctacaagacattatacctatttctgttctaccccaattatattagatttcttaagagctactatttcgaattttgttctagagcttactcccaaattttttcctatcagagcaatatagactgctatgggatatactaagctgggcaacattaggcacttaaatatcacaatttaaatgtcaaacacaattagaatgatctaggacaaaacattgatttctttgcagggtttgtgtttctccacattattttctcatgcctacaccgtgactagccctaggtggcccctcaaccaataataaacaaagatggaagtgatgctagccttcatgaagtcattggctagatagtaacttttgaagagtcgtaggtggttagggagacttaagctacactgcagcataaatgatcttataggtgcactaattctgtctttgcctccacttcctcctggcttcaacattgataatttactagtcatcattacttgtgttgtcaataaggaactaaaatggatttggcactgtgctactccaatcagtattatactttaccttggataaatttaaattttatatgtatgaagctaaagctgaatcaaattgtgatgatttggtcactaagattcagtaactgactactaaggtaatagaactgatgttttttagccgaactcatcataatcataggttctttaaacttctactagaaatagtgcatgtttatttctaagttcaaaaagactatactctttttaattgatgtcatattttaccctaaaatggctgcattttagaataaactcattatctgtgtaggattttcaagcacattaatttgtcttcttttattaatgataatagaaaaacccagtgctttaaaatacaatcatatgcaatttatgaacattatttcctataacacttatttaaaaccttgaaataaagtatttgccctgtaaatagctatttttattttattatattataaatgtgttttatttatggtgacatagaataaaactcttaaataattcaaatgtagaactttctggcaagcatgaggtatattttaaaatattttcaagtttcaccaaatttgtttatagttttctgtataaaatcaataaggtatatccacattactactctgtatccaatggtaagatgaaagtggtcaagctagcatgttcagcaaaagctatgcctagagttgagctcaataattcactaaacaactcattgctgtatctccattaccccaaaaaatgccttgagaaaggacctaatgctatttgttgtgcatcttcaaagtaactcagaattgttaaaaacttaaattttgaatataccaatttctgttatatactgtcatccaaagaatacttcaaatatgtggagccattcatctgaaaaaaatcctcaaaaaagtcagtgcataaaaatattatttggatttctgcttctggccaaaattgagtaacagagaccagatttgctctctcctgaagcaaccaataaaacagacaaaatacatgttacagtagttttgaaggcactggacatcagatcaggatgttttaagatattggaaaatggaaaagcaagcaagtcagttctatgcttttgttagcttatggcctggaacttccagactatgatgtagagaggaagtatctctgcagactccatgaatggatgagatgaagctgagtttaggaaaatcagggtggttgtatagttcacaaaacagggtaccacagaggagagagttgagcagagagagaactctagggatcttctcaggttccccttgagtactgagaagattattcaccaagcatgtgtcttagaaaactacctgaggctgaggataagagagaacaccacctggcaatcacactgtgccagaacagtgtctgttcctacactggcaaacacttcgttttaaatgcgcattgggtagagtattaggaagggtcttgattcactagtgaggaataattagtcttagaataaatggtatgctggtcctgcctaacaaattttcaaatgtttaaagatacaaaaggatcaaactgtgtaaacaacataactatgtcccgaaacaaagatcaataatttttatgggaatacaaaaatatccagcacttaaaaaaagtaaaattgacagtgtctggaattcaattgaagattgtcaggaacataaaactgcaggaatatgtgacccataataaagagaaaaattaatcaaaactgaccaagaagtgacacagatgttcaaattagcagacagggaacttaaacagttgttataactgtattgtgtatgttcacaatgttaattagagatatatgaaatataaaaaagacacagatcaagcttgcagaggtgaaaactacaatgtttcagatgacaaatacactggatgaaattagcggcagattaaatgttcaaaagaaaagataattgacttgaagacagcaatagaaatcattcaaattgcaattgacaaatggagtttaaaactcatatagagtctttgctattgtgaatagtgccgcaataaacatacgtgtgcatgtgtctttatagcagcatgatttatattcctttgagtatatatccagtaatgggatggctgggttaaatggtatttctagttctagatacctgaggaatcgccacactgtcttccacaatggttgaactagtttacagtcccaccaacagtgtaaaagtgttcttatttctccacatcctctccagcacctgttgtttcctgactttttaatgatcgccattctaactggtgggtgggggaggtgggaaggatagcattaggaggtatacctaatgtaaatgacgagttaatgggtgcagcacaccaacatggcacatgtatgcatatgtaacaaacctgcatgttgtgcacatgtaccctagaacttaaagtataataaaaaatatatatatatgaaacttagaaaaaaaactcatacagaactacaagggacataaaacagccaaaacagctttgaaaaaaaaaaaaaagaacaaaaagttggggacctgcactatgttatttcaagactcgtcataaaaggtacaggaattaagagagtgtggtactggtataaaaatgacaaataaactaaacagaatagagttcagaaatagacaaactcacctatggacaactaataattgacaaaagttcaaaggcaatgcagtggagaatgaatattttgtttttatgcagttggaataattagatactcattttaaaaaagtgaatctcaacatatcactcatatgttatacaaaaattaactaaaatgggttatttacctaaatataaagcataaaactaacttaagaagaaaatttagaagaaaatactcatggtgttgacttggcaaaaatttcttagatccaaaagaatgatttaaacaaaaaagctaagaaataatactctggataaactgcactttaaatatttgagaagcatatatgtgatataggacttacatcccaaagagtcaaagaatgctcaaaactcaataatatgaaatcaaacaacctaactaaaaaaaaaggaggggattaaagatttgaacaaccacttcataaaagaagctatacagatggaaaataagaacagaaaaaggtgctcaacattagtaattaggaaaatgaaaatcaaaacagaaatgagatacttattagaatggctaaaattaaaaagactggccataccaaatgttggcaaaaatattgagaaattataattctaactggcatgaatcagatttttactatatattcgtgagtcttcacctttcagtatatggatttttttttctgtcttttaatacagtactgtgtttccgtctcttctcctcaacacattaatgtcccattcactatacccctagctcacacagcctttaatattaataaaaatctcaagttggcatctaactttagataccttcctgatatcctgatgtgggctatagcaaacatttttttttttttttttttttgctacagaaatcccaaagaattgttaagcataggtatatataaagtctcttgtcaacctttaaaatcaattaacttcagaacaaaatctcaaatgtcataattaggggtgaatcactaataattggaaatatcagttttatttcttttctaaattaaataaaaaattaaattcctctcttaggttctatgagacaattccatagtaaaccttatctctaatgtattttctatccgctagctgatttctttatatacagtggctaaaaagtttgttagactctaacttcagaaacaagttcatatttgaatacttttttttctaatgacaatgcctatatataaaatgaaaaagcagttccaatctaccctctatagtataacactatttctacttagaaactaataataataatgataaatctttgcttttatcactcagtacctgagcttcttcctgttgctttttaagctgttcgagcatctgctgaaattcggcctctttttgttctgcttcttccaaggtggcctgattctgctcctcataggccatggccaccacagccaggatcaaattcaccaaataaaatgagcccaagaaaatgaccaggacaaaaaatatcatgtatgttttcccagcagcacgtaatgtctaggggaaatgggggataattccatcagtattttagtataatgtccccaaataaatatctgattaccacagttagatagtcagtagactaattagctttttagtatccagtttattttcaccaagaattttttggtattgatatgctcaacacacaaaattaagaatcagattatttgaggcttgactgcagtcttgttggatataaatacattttaaactcatatatagtggatatatatgtgagccccactataatgcttttattagagttcatatgcagagcaataatatgacaagtaagagcactgaacctttaaatcctttcagtgggattccatttgcactgcagctattctccataccatctatagatgacttttgctcccctccccttctagtctcagttaatagctagagctttaatttgaaattttcacatcaacatcactgatttttaaaatcttttaacgtgctgtttatataccaacaactggattatcaacttctaagagtcatgagcatctccaagttcctagcagaatgcctttcacataaaaaagtcctcagtgtacatatataggtactgactcagtgagcaattaggattcctggcacacttgctttatgttggaccttcctctgtgttccagagtgttataagcaggtcctttcccttcccttcccttccattcccttctctccctttccctttccctttccttttcccattccctttccctttccctttctttttttgagatggggtcttactctgtcatctaggctggagtgcaatgatatgatctcgactcactgcaacctccacctcctgggcttgggtgatcctcccacctcagactcccttgtagctagggctacagatgggcgccaccatgctgggctaatttttgtattttggtagagatggggttttgccatgttgttcaggctggtctcgaattcctggactcaagtgatccatccgcctctgcctcccaaagtgctagggttacaggcatgagccaccacacccagcctatgcttttcatttcatacatgtctataaaaataaatgttatgcatgctcatttggaccttaccaactggtaaagattttcccagtagtcttgagtcatgagtcgaaatagagacaggaaagcccagctaaaggtgtcaaagcttgtgtagccatagttggggtttcgaccagccttcacacagatgtatccttctggacactggctataagagagagaaatggaggtagggtcagtttagaaattacagcaatttcaatttatttgacttataggaattttcaaaacccaaagctgctatctgtgacgaattatcttgctttaatttccagaacactttaggtgattgcccaccgtgaaacttatcagatgaaattcactaggaagaccgatagaaaatttagatgcaaataaatatttacggacatttagaatggcagaaagctagcaaccacacacttttggctctgacattaccatatttctactctttacaaagtggcaagaatcaatagttaaaaattaaggccgggtgcagtggctcacgcctgtaatcccagcactttgggaggccaaggcgggcggatcataaggtcaggagatcgagactatcctggctaacacagtgaaactccatctctactaaaaatacaaaaaaaaaacaattagctgggcgttgtggtgggtgcctgtagtcccagctactcgggaggctgaggcaggagaatggcgtgaacccgggaggtggagcttgcagtgagccgatattgtgccattgcactccagcctgggtgacagagcgagactctgactcaaaaaaaaaaaaaaaaaaaaaaaaaaaaaaaaaaaaaaaaattaaaagccagaaaacagacaaagagtggggaatcaaccatttcattagctggttttgtagaattttctaaaataaagttaatatttataacaattttttatttacagaaaaagtatgaggatagtacaggcttcatacattccatgccattttcaatattgatatattgttattatttaattgagatgggatcttgctacgctgcccaggctggtctgaaacttctgggctcaagcaatctcctgccttggcctcctgaagtactgggattacaggtgcgagccaccgcacccagccttaatacattattattacctaaagttactattttattcagatttcatcagtttttttctttttttttgttttgttttgagatgtagtctcgttctgtcgcccaagctggagtgcagtggtgcaatctcggctcaatgcaagctccgcctcccaggttcacaccattctcctgcctcagcctcccaaatagctgggactacaggtgcctgccatcacgcccagctaattttttgtatttttagtggagacagggtttcacagtgttagccaggatggtctccatctcctgacctcgtgatccgcctgcctcggcctcccaaagtgctgggattacaggcgagagccaccgtgcccagccctcagtttttttcttaatgtcctttttttgttccaggatcccattcaggatacacatcgcatttagtagttatgtctttttaggctcctcttggctgtgacaatctctcagacttcccttgtttttgatgaccacaacagttttgaggattactggtcagatattttatagaatacccttcaattgggatttgtctaatgtttgtctcatgattatatttaggttatggatttttgggtggaagactacagaggtaaaatgtcactgtcatcacatcacatcatgccaagggtacatacttatcactcactatgacttatcactcttgatgttaactttcaccacctgtcttgaggtagtgttaggtttctctactgtaaatttactcccttttcttccttttccatatgtgctctttgaaataaagtcactgtgtacagaccacatttaaggaacccgcagttatgatcttaagtatataccaaaattatttgaaattattctgcataggatatttgtccattcatattttatttaattattcaatcatttcaattaacatgtagtcatggatagtcattttatattttggattacaattcaatgatatttcatttatttgttcaaatggcttcatctttggccactggaagctctttcagttgacacctgtaacagtttgacatacaccatggttgtgggttgcatttttttttgttttttaacactttcttagttttaggtactatcagatgctccaggctcatcttttataatttctgccgcagtcctagaatcaaccatttctccaaggagccctagttctttttattggaaaatggtattagaaaccaagatctgagtgctagctgtgtttgttgctactggggtgtcattgcttctaggccctctcagctgacagaacaaggagatacacatgtttgtaattgctcagtactggtacacatgcacagtggtttcaggattgttaatctatactaccattggaaacaactttatcaactagggtattgttccttttacctttagtcttacagactccactcatttccaaagttacttaggttagcatgttattaccccaccacctacagtgaggtcatttcatattttgcaatacatgtatatatttttgtcacatattccatttcttcctgggatccccaaacctcacaaaagattttttttttaatttgtatatattaagattcactctttgtgttataaaggtctatgagttttaacaaatgcattaagtttcatattcaccattatagaatcttagagaacaggttctcaccctaaaaaaaaatcccctttgctttacctagataatccctcaccatgaacccctggaaaacactattttcttatcatctctgttgctttgtgttttctagaatgtcaggtaattgaaatcatacagtatgtagctttttgaggttggctttttctcacttagaaatgtgcatttaatattcattaatatttgtttgtatcttgatagctcatttctttttaatcactcagtaatattttattgtatgggcataacaatttatttatctatacaactattgaaggacatcttggttgcttccagtttggggtcattgaagggcatcttggttacttccagtttggggtcattatgaatacagctgctataaatattcacatgcaggttttttgtgaagacataagttttcaaattgatcagctaaatacctagaagtgcagttgttggatcatatggtaagactatgtttattttgtaagaaaccgccaaactgtcttccaaggcggttgtctagttttgcattcccaccagcaataagcaagagttcctgttattctgcatcctcatcagaagttggtattgccagatacatttttcagtcattctaacagatgtgcagtggtaactccttgttgttttagtttgcaattccctaatgacaaatgatgtcgagtgcctttttacctccttaataaccacctgtactatatactcgtgtggggtatctgttcagatcttttgccagttttaaattgggtcatttgttttcttattgttgagttttaagagttctttagatattctggacactggtttgttgttttgttttgttttgttttcttttgagacagggtataattctgttgcccaggctatagtgcagtggtctgatcatggctcactgcagcctcgacctcccaggctcaagtaatccttctgcctcagcctcctgagtagctggtaccacagatacactacaccatgcctggctaatttttttatttttattttttggagaaacagtgtctccctatgctgcccaggccagtctcaaactcttgggctcaaatgatcttcccctctcagcttcccaaagtgctggattacaggaatgagctacttcacctagccccagtctttttttttttttttttaaatcagatatgtgctttgcaaatattgtcttccagttgctggtttgtcttttcattctcttaagaatatctttgtaaaacagcagcttttaattttaataaaatacaaatcatttatttctttaatggaatgtgccgcttaaatacaaaatggttttgtatttaaaactcatcacctggctcactcctgtaatcccagcactttgggaggccgaggcgggcggatcacgaggtcaggagattgagaccatcctggctaacatggtgaaacctggtatctattaagaatacaaaattagccgggcgtggtggcgggcgcctgtggtcccagctactcgggaggctgaggcaggagaatagcttgaacccgggaggcggaacttgcagtgagccgagatcgcgccactgcactccagcctgggcgacagagctaaactccgtctcaaaaaaaaacaaaaacaaaaacaaaaatctcatcaccaatggccaggcgcagtggctcatgcctgtaatccccagcactttgggaggccgaggcaggtgaatcatttgagatcaggctcccactgattctacattatggtgacttgtacaattatttcattatatattacagtatgctaataatataaataatgtacacaataaatgtaacgtgcttgaatcatcctgaaatcatttcccaccaccacccttggtcggtggaaaaattgtcttccacaaaacagtccctggtgccaaaaaggctggggactgttgatgtaaattacttaagccataataggaattcattaaggggaatagattattatggtttaataggaataaagtatgtattaaccaaatttatccaaaattttatctgggcttttatgttaatcatcatcataataaataatagttaataggcaataaattcttttctttttttagagtgtgctttttttttaaatttattaaaaaaattttttggggggacagggtctcgctttgtcatccaggctggagtgtagtggtgccatctcagctcactgctacctccatctttcacgtttaagagattattgtgcctcagcctccagagtagctgagatacaggtgtgccccaccacacccagctaatttttgcattttgtagtagagacaaggtttcgccatgttggccaggctggtctagatctcctggcctcaagtaatccccctgcctctgcttcccaaagtgctgggattacaggtgtgagccaccgctcccagccatttttcagagacagcctatcacctaggctggagtgcagtggcatgatcatagctcactgtggcttggaattcctaggctcaagcaatccttctactttagccccctgagaagttaggactacacgtgtgcatcacaatgcctggctaagtttttctttttttcttcttcttttcttttcttttttttctttctttctttttttttttttttttttttttttgttttgtagaggtagggtcttgctttgttgcttaggctggtacatacaataaattcttacaattgtccatgtgatagttcaaatactttatgtgtattaaatcattaatcatcacaactattaaagggacagaatattactctctccattttaacgatgagtaaactaaggtacagagagcttaggacacttttccaaggtcaaagagcttacaagtggtgaagttaggatttgaaccctggtatacatgaactctacaacctatgctcttaccccctacattcataataaggctaggaaaactgtcaggaaaaaaaattccccaaagctctatttatatgactagtatacattttcattaactctcttagatttttatggctacaccagtttccctttttaaaggatgactcaaaatatatttaagttccgtgtcctaagagtcacttactattgctatctctcagctcttaaaaaattccctattttgatttaaaattaacttacaatactcttaggaaaatatttaagggttagagaataacagcatgactaagatattatggcatcttttgttgtaacgtgtggcctaaaagaactattcattatgtcaactgatacttggacatgcctttggcacacatgcacccttggcttctttgtatacagaaatacatgctccttcaagaatacttaaatatttcaaagcacttccccaagtgtgcttccaccctgaagaccacattatagtctgggtcttttccagtcacgacaaaactcatcccattgatacatatgtacaccaataaaaaggggcccatcttgtgttcctgtgtttcctaacagctctgatagatgtacagcaaagacagactctgggccttcacacattggagcatcaatttaagaacatcttaactgtgaaattttggggaaaggtcttcacaaagggataatttttaattgctgtgagtttaggaccagtggcaatccggtaaggcagacaaggcacttcctaggggagcagcactgctctttattgcatacatggtaaggctacacatataaccatgtagttgttttcctacctacttttttttttcgcaaagagttctatatcttaaaaaatatattatgtttcttaccctgcatctgagccatttccacagagtaaagggtctttttgcccatccaaaacataaaagtgacctgttaatacaaaaaaaaacccattttatttcatattaatcctattcacattagtattagtaataaatcagagttggactatttcagttatttacaaaggtggctgtacacccacagtctcaactatttatagttgaaaattcattcagcaacactaaggttaacataatgtaatacttcttactgtcatctccaatgtaatccttccagttaaatgtgctcattgttacattaacaaatgtcccatttgaatccattgtgccattaaagtaggaagtggtgttggtttcaaaagcagaatcgcttgggggccactgcaaacatttattcctcagattgcccatgaacagctgcagcccaatgagagcaaacacgctcagacagaacacagtcaggatcatcacatcagaaagcttctttaccgactggatcagggcccccacaatggtctttaaacctgcagagagagaactataggttacctgaggaagagtgccagaaatcatgatttcttaatagtcacacacattctctttcccccataaatgattgcttgactatttagacaccaaagctgtatggatagcctgatgatttgggaaatagatgaacagcagattttacacatgaacagtgtgcttgctggaaattcaatatgaaggtttaaatatctagtcaggaagttttgtttgtgtggttttacatgctgaacaaacatacaaaaaaacttggagttatttttcatttcagattttgtgtttcatgcagccattttccaccaatccattctttactctagcctccaagcagtagtaatttagaggagaaaagaattttaaaataatgtaagtctcatgtctcatgccatatacatgctcttcaacaataatattttctcctttgtaaaaggagatccatttttgaactacatctgcagcgaatggtaaaatccaaatctgttagtaaagccatggtagtgaaaaagagagagagagagcgcaagaggcccaaattagcattttttgaagatgtctcatgcaattttctgttaaactcaaaggctgactttataaatacgcatgtaatttataaaattttaggagctaaactgacattgaaacatcatttggcattatttaacgggatgaactgtaataataagcaacaaggctaatgctgtaagtcatataaattgatttcaaactcaataattaaagtcaacctcggtgtttaacctagctctcacctggaatgactgaaattgttttcagtgctcggagaactctgaatgttctcaacgctgagacattgcccaggtccacaaactctgtcacatatctgtaataggggagttcacacacaaacacaataacacacaagaaaagttggagatataaggggcctactaccttacaccagtttcttcttacctggaattacagaaatagttttcagagctctcaagactctgaaagttcgaagggctgaaacattgcctaggcttacaaattctgttacatacctgcagaattaaatcagagttactgatagttttggcaaagtttatactaaataaggacttaatgctgggtttggcacatagagccctgtgagtttaacaaatggaattgctatagacctcaggctgccatatgctaaaggttgcttttaagaaacaaaatcgtgttgctttatttcaatgtaattttcactaatatgaacacatttgtttgcaaaactaatccaagtacagttgttgctattaaattgtagtcaatgaataacttcattttgatgaagagaaagactatatgacatgaagataaccccatttattgatcatttactggatatatttacattgcaatatgtattctaatatgtattcttaaaatacacaatccatatagttaacttgactaacaagaaagctctacatttaatatatgacacaaagaccttgtttgtactatgactattttcactcctttgcgcttatcaaattttcaaagttactcacgccatcacaatgacactgaaatccagccagttccatggatcacgaagaaacgtaaaatcttctaagcaaaaccctcttgccaagatttttataagtgactcaaaggtatagattccagtgaatgtgtacctaggaaaaacatccaagccaaaattaacaattttgcttgaactgttaaaataaatgttttcaatcatagcaaatcctatccttttgtggtttttcaattcattaaaatattgttccttacttctatttaccaaataatctattcatttagttagttttacaagcctgagcaaagagttaaactgaagagaaaatatattctttaggaatctaatctggtttaactatttgggttttagaataatagtttcatgtatcttatggataatcatctagtttgaccttctagcgcagcagtatctgatagaaatgtaatggaagccacaaatgtaattttcaaattcctagtagcaagcgaaaagatgagaagaagcaagtcaacgtattttttatactgcattttatttaaaccaatatatctaaaatatgaaaattcaacaattaatattagccaaatttcaaggttccatagccatatgtggctagtggcttcctcatcagacagtacaactttagaggcaacatagcttggattcatttacttaaataataaaatattttattcaaatttcttaatgagtagactcattttgagggctagtttacatgtctaccatagaaaatatatttcttttttttcaatttttaagaatcatgtagagttataaactgccccccatttctctctcttctttctctctctctgccctccttcctcccaccctgagtgtatgtgtgtgtgtgtgcatgagcatgctgtatagagatgtgtgtgtgtgtgtatatattatcatatgaaatgttccagttcactagtattttatatgtgtgtgtttgcacaaatgccaaaatacacggatacacaaaattcttaaatcaaaccttgcatcagctactatctctatgcaattgggctaaatcattcaaaccttgcttaaattcaattttcagcctccaaaatggtggaagacttttctatttgctgtttaatgtcatgtatttctagccctcttttctttgagtcttgacaatataagttattgctgttttcgtttttttcccaaaatagttgagagtacttgtttttcaacattgtgttctttaaaagcacaatttaagtttatttttcagagcacttcacccaagccacaaagatttgatttactcatattaaattcattagatttttcagcctaccagtatttatatatgaaaaatgttaggatcattattttgaaatgttttctgcacaagtttctttcatatgagggaacaaagacatcaagaataatttatgcagatatcttcaagtctagttttcttaagtacattcccttccttttctcccccaacaattcaattgatctcataagcaataattcctatctttacttatatgaagtagctgactattaggaagagatatattttacaatatcaagcttatgtttactgtgttgtagtttggatcgttgtgtgacacacataatcaccgtgatatttctgtctgtagagatagctggccttttaaaggcctagaaacaccacacatgtatgttctgtttcttgtattagtggttagtgccctgtggtttatgctgaggcaattctgtcttatctatagagttactaggaataagattaaagtccctacttttgttcttgatttggggaaattaagaaaatatgtgggtacatttggaatgtatgggaagtgttcatggctgtccatggaagagagtcctagagcctactgagacagagctctacacagaataggtattcaaaaatggttattagtaactaggttgggcaggtaagtgggagtcaggggacctttatctttcgtggctatgcccacactaggctcataatcaagctgtcaattctgtctatgttcctgtaactttggtgttttaaaaccttgaaatttggctaatcttaattgttgaattttcatattttaagtatattggtttaaataaaatgcagtataaataaaattaaataaaatgcagtctatagaagtgccttgccttatataacattcccctcactatataatatggttttgtgtatgccacatctttgtacagggactgtttcaaatatcggtgacttcagttttcatctcagaactaagttatcttctgtttcactgaacccagggtttggggtagtaaccactactactttgcttttttcctgctggcttgctttcaagctactgaagacaattgatcagaaaacctgagcaaagttttccagctgaatgatgcaaatcaaaaactttctaaagctaagactgccttcataatgggtataatcatctctaagttattactgcttctttagaaagagaggcctgtatattcaattgccttttttttttgttttgaaacagagtttcgctctgtcgtccaggctggaatgcagtggtgggatcttggctcactgcaacctccacctcctgggttcaagcgattctcttgtctcagcctcctgagtagctgggactacaggtgcttgccaccacacctggctcattgtttgtatttttagtagagatggggtttcaccatgttggccaggctggtcacaaactccaactgccttctttaactatcttttaataatgttatacaaataaatgaaattgatacatgtttaaatgcttcaataatttctgctgggaaaaccacatacagagtagtcttacataggagtgtccattttgttaactccaaaatcatgtatagtaaatgagagttctaagttaaatggctttcctcaatatgggagctggattctctattacaataatttctaggcagcattttgaagctactatttttttttaaataacatgttaaataactgacaaataatggcttagagtggtacagtaaatcctcagagaaatctataaaaacggaactaaaagtggcagtatttgttacactatcttatctccgattgtacattacttttaaaaatataacaataaaaagagcatactgcattttttacttaaccagtcagatacctgattattgtattatactatatataagtagcctatataaccactttgtttcactaaaaactatgtttctttgatgcaaataacctcatatgtgactgaaaaataagaaaatgaaataatgttgttacgataaagaaattgtgttagttcatgcacagttttccccagcatattgatgttttgaaacaatgaagggcattttttctcacacttaaatggaaaatcccttgcaataataataataaaaagatcttgatactaatacacaacatccacagaagtgttttcttttagtgcaacaagggcctggtttaacatcctgaacaactaatgtgcttagacctttctccatgtattaaaatacagaatgaagcattttattttgatgaaatcatacaaatatccccagtctccatttcaagggagaaaggatgaggcctgggatatgaggccacaaagaactcaatggctatgattttaggtacaaacattagaaaagaatcaactgggcaagtgtctttttattgggattattatggtttctatgttgtattctagttacaaagttccataagttttactctcccccaatcatgtttcccctaagccctgttattttatgaacacagttttatggaagacattttatttcttttacagaacacatctaagctgtttcagcacacatgttgtgtataaaaaacttacatatctaaatataacttagacatcttagatgtataattaagacatctacttaatttagagctaaaaacctaaatctattctattcgaatataacaataatcactatatactggaataaaataatttaattcatcaaattactgaactgatcactgtattttatctcaaatgattaaccatgattgagacctaattttaggctaggtgattggtttagtttaccagaaagcatatactaatttataacctctctttaacagatattgtcatgattttgttggaaaaatacttacctcgtagaagaatagctcccccaaagaacttcccttatcttctttcatattatgaaaataactttttcttagacagaagtggaaaccataagtcaggctatacccacaaggagattgctagagaatttgagtgtgcatttctcattcccagaagttattcctacttactctacattctttgtccagtcaggagggttgctcaaggtcataaatacacagttggtcaaaatagtgcacatgataagcatgctgaataaagtagattatagttaaggaataaatgttagtaggttaccatggccatttataaatgatccaaaacacacaaaaaagtttatcgatgcaaaaactgtgaaattaatattatttgttttaaaacaatgataaaataataagaaacttcaaagcctgtgatatggccttggtgcactctttttttcattttataccatatactcacaaaactgaatttaatagaaaaatgatctctatttgaagcaaatgcaagttattttgcattccaatcagttgtgtgaaattgccctggaagaagaactcaccatcccttagtaagtttatagtatgccataagtgtaaaaggtgtacttcagatatattcatcctcactgacttataaaacgttaacgaatgcaatgtaaaaagtgtgagaatgtagagcccagtataatcaaagattacattgattgagaattctatcataaatagtaggtttgtagtgatgtaacttactcctttacaatttatagcataaaagagggagatccaattttgtgctgataaggtaatgttattttctagctttttatttacactttagattgtggcggaccccaacagaccatctggctatactcttgtatctagtccacattatacctaaacagatagcactattctgatgctcttctgagaattagctgtagtacgttctcttgggatctaagtccagacttccctgtaagaaagtttatgattattttgagataaatattttattttagaatataaatactttccaacatcaagccatagaatgagagaattcatacctcaaaaggttatcagtttcatttgccctgtctctaggtgaatcagtctttaagtttatatagaagcctgctttgaatctgcctatacaaaattcccattcttgaacactgcctcagaaaatcaccattctattttatcattacttgagaattttcttgaaatccaaacatattctgcccttttacatatgctttttgactaacattgtaaataatttcaagttcgactttttgatacatattctcaaccaggtacatgagcacatagtaagagtctgataaatatttactgaaaaaaagaagggaataagacggaagggaaaagggaagaatgaaggaagggaagaagacaggaaggacagaaagaaggaaggaaggacacaaagaaggataaatccaggcgctgaagatacagaaacaattaaggcgtaaaagtttgaacacttggtaatgcaaatagtaatactaaccataatctaatctttagcaatggttatatatgacctcattgaagctgataaaggtgtaaggagatttgctctttttcctactatgtgtttcctttgcacattcactatcatggttggttacatattttcttctataatgctgtagtcattctataatactctcattataaatagtggaaaaccaatgcaaataaatgaattaaactaacaatgttaccattaatctcaaagaaattttacagatacttgaaaatataactgacattttctttaaaatcaactgttagaaatagcatttaggcaattcacattaaaaggatatgaatgtaccaaaatcttgatagcaattttcctaacagggtttagtggagttaaaatatacaaggcagaggtggcactgaatcggaaaattgcctttcctttattcattactataaaagtctgaaaaagaaaatacgagtaaaattactaaattagacatgggcttatttaaagagcttacatacatgaagaactttttaaaaaatagaatttgtttgttcaaacttgtttgtttaaaccagttgatatatcataactacaaacatgttagatgtttaaattaacatatagttacaaataaagatactatttactattacctaatctatctctaaggttccaacttgctgatacaaactgacaattctacacaaatttttttatggaattgtagcgttacagattccaactctatttaaagcttaccatctgtcttcagctttggtaacttttcagattactctgtacacattgctactaaaataatcttttataagtattttaatcatatcaaatcttttaacttcaaagtttatgatggcttctgattgtccctgtagatttaaaatgttcaaacaggttgaataatctggttttgctgactatagatgtgtgagaagggttcaacttctcagctaatactgaagagagatggatgcattgaaatttagtctgaaatacaccatttcaaagggcattccacaattaaaattctatgatctgaaagctacaatcatccacttagtattagctatgctacaagtgattatttaccatgttcctatagaatcatcttttatttttttcccactagagtcatctttgctatggccaattcaattcagttgtcagcctcactcacaactagtcaaactctccctatgactctgaatatgaatgtcatagactcctagaagaaggtggcaactgaaaggtcatttaatgcaaactcccttcatttcagggaaatgtctccacaacacattacaatatagttccacctacagtgaccccctattatgtcagaggttcttaatcctgcctgaatattaggctgtcctgtaaagattttaaaattgccaattgaatgaaaatttctgagggatgggcacagatttgggtatttttaaaactttcctgaggcgattccaatatgcaatcaaggttgaaaatcccttctgtctgggaattttctcagctatcaatcacctccttaatcatgtccttccaaataaatcacactacctcctgatcactccctaattgtttctctttaccagtaagtcttagtacattaatttgtactcttttacatgttgcttgtaattatagtcaagtagcaatttacacagtgttcattccagtgagaactaggttagaaattgttataaaccattgagcataaagagcttgtaatctactttttctccatttttttcacagtatttaatagcctggtttgcaaataaacacttgttttaattaaatgtgggtttaccttaaagatactatttacctttaagacatctattctgtatatccatttacttaataatatgtttctctcctttaactaggggctatatgccatacatttatgttcactgacaacatgctttgtttgagtaggtagacaaaaatatttatattgtcagtataaagggcagggaaaacaatttctctgttcattgctcttttgtatttaagaccatggtgccaaccattacttaactaaccattttccagaaactgaacagtttttctgttcattatccctttgtgtttaagaccatcaagccaaccattatttaactaaccatttttcagaaactacacagtttctctgttcattgcctttttgtatttaagaccatagagccaaccattacttaactaacaattttccagaaactgcacactataaatgtgaatagttttatgaagcgggcaagcaaactattctttactagcagtaggactgtgtgtaaaggacagtggaccttggaaagactgttgttgaagcacagaagcattaaagggttgccttggagtcacaagattagattatttaatattacagttgaacagtcaagatccatttaggcattcagcaacacaacagcataacttgaaaaagctcaccgtaatttaaggttcaggtactcatgctcttttgaaacaatttccctgaaaaagcaatttctgcttgcgacattaggagagagtttcattttgaactatctccaaaaacagagtgaacagcaataaattatccctttgaacatggaaccctttgctcctcctgcaagattagccttcgtagtactagcggaattacagctgacatgctaagagcatcttcgttgaatttataggttctaaaacagagcaggccttaagactacaatcccagtttatgtctcaggaacaatacctgacacaaagagaaccctgagttctgagaaatgcagaataaaatactaatgtcctgcatagtgaaagaattgcaagaatttgaaattatggggctctgatgatatgaagagatatacctaaactgaaaattacttgagaaaatgacagatgaataggggagagatagatcgtcattgctacagctggaagtatgttaaaccagctattttgtactctggaatgttacttgcttctttttcctagaatgttacttagatgcacatcttataagtttactaaaagttttactactttgtggcaagaataagatttacatctcaatgattaggaccacatcaatcagagaactcaaaaaatgatgcagccaattttttaactttcccttttattttattatgttaataagcatagtatataatttcacttagtggttaagagctctggctctggagtcgaatgcctggactcagatcctggattcaccacttaaggagtgtggccttgagcaagttacctcatctctctgtgcttcacttccccatttacaaactgagctaacaataggacctgcctcactggttcactatatagtaaatgagttcaagaacttagcagtgcttgacacagtatgagcacaagaaaagttagttatgattatcactgtcactattattaatagcaccctggtcaaattaaatgccattaaaatacattgtgatattactcatttaattaaattaggtattcaaaatgtatcactaattaatgatggtaaagagttacataatgctttaaagcttttaaatgccttttacttgtatttttccatataattaacacagcttcataacatatttttaaattctaaaacttcctccattagcttcttactttactccttctatgctaagaatgacaaattacctccttgtttaatagcacctcaatcttcatctttatggatacttcataaacgaaagcagtgcagccaaccgtaaagactatctagatgtctcgcaagatggttcacagccactatgaataaatcagggtctaagtctggctctcagccatggaggcaataaaaattgactttgtcaaaaacagaggacaattctgttttttagtggcagactcacattaaccaaacttgaaaacctgatatataaaataagaatgccaacctatttatttatttagacaggacctcgatctgtcacctaggctagagtgcagtagcacaatcatagctcactgcagcctcaaactcctgacctcaagcaatcctcctgccttggcctctcgaagccctaggattacaggtgtgggccatcatgcctggcctccagtgtatttatttacaatgagatacattactttcatatggactgagataattgtagtgatgtaatgagcacgttcttttcttcaagcaggtttaggggaaaacaaattgtagtcagaaggtttcttgctgaatatggagcccaagccagctgacctaatcaaatgatgtggaatgtttaatagcatgtgttaggtagttcagtgtagcccctccacaatgaggtggcctggccattgggaagaaaatgctttcagtgctactactaaagttctgtctcccttggaaaatagtaacgtttgcctctgttgttctccttttgtttcccccttaatcttaccagcctgattgattctcttttttaaggacacttcctttctttaagtagcaaatacttttaatcatagcagagtaaatcatgcctcctttcttaaagatatctttacaaacatatccttcagagcaacagttttcaccggataatattttgtccaatttcttggggggtgacttattgtaatcatcataactacatttcaaatttttctttatcaattctatagtaaattgttgaaataagttatttttagaagtacatgaatgtattaaatgtcaccttttatgaaactagctataaaaggggaaaaaggagactctgtttagctatttacatgtagtcttatgactttaaataaaacattaaagcttgctattcaaagtgtggccatgtaacagcctgatgatttgtaagaaattcaggatctctggccctagcccagacctatggattcagaatctgcaaattaaaacatcttgaggtaatctgtatggatgtgcaagtttgagaagtacttatttagaacaacaggactaattccatgtctgaatggttgtcattgcctttagccatcattgattttataaattataaacttttaaaaggatgtgctttgactaataaaggtgtttaatatcttccataatctataagtcatcaactcatggtgatactaatttatctttagtttctacattgagctatttttacgcttttaagtgtaaaatataaatcgtggttataaaatgccttaatatccaattagaaagcatagagtataccacctattttttatattttctataaaatatcacccagctagtttaactatagaaaccagctaattctgatacaattatgcatttattttagcattaggaaagcacagtcataaccactaatttaaatcatgtatggatggagaaaatttgaaagttctttctttttggtcttccaattttgacatttttttcttcagggtgatgttttaatggtatacatgatccagaatctagcatgccacaaactatataaggttaagagaagatcctaatcatattctaggttactgggggggaaaggaatctctgggtgaacatgcttcttcatgtattgtctggctacaggaggatgctaagcagattatttattgtcctctagaatataaattattgtgaaggtacatcaagtcagtcatgaactaaaaaataattaagtacaacatatgctcataattcttttctgcacaggtattattctgtagtctaccctgtgcttgaatatgtcagccataacagatatttcactttgttgatattaattttaattttgactatctgaattatcactgtgaaattgtagaaatcattcatctattcatatttcctgactgtaaccaactcttgacttcatttcttataaatgtttgttttattatattgtgataaaaataagtgacagtgaagagtattataaaatctttaacagaagaaaaattgtgatgctgtatataaggcccagaaaagtatattacagttaagagtttcattaaagatttattagaagtctaaaatcaatactcactttcttattgatatagtagggatccaggtcctccaggggctctgacaccatctctggaggaatgtctccataaataaatggaaggttctttccagcttccaagtcactatttggctttggtttgttctcatcatcattatcttgttcctttttgggcttcttggctttctcttctgcagcacgtttttcgatagcagcaagagattctctagtaaaaaggcggaagctttcaggtcctgggggtaccaacagtgcctgtgccatcttttcatcctgcacatttaattacgtgtagcttcttgcatacgaattacctgcaataaaagaaaaattgcacaagagttaggaaagcaagcgattgggcataagaacatcaaccaaaatgtcattttttagtaactttttaaagctataaacattaagtcatgcttttagtactgcactacacatttgaacttgaaaacatcatcattcaacctcattctcaataagccaagttcataaatctatcaaaagtctgtacttaatgttaattagtttgatttagccattctacaatgtacagtatatataatatataaacattatattttacctcaagaatatctataattttgtccattttttaaaagcatttaaaaaaattctgttttgacactgtaagccaaaatatagtatactttcagcaaaagagtaatgccagtaaagtttgtcaataaaattgcttaattattctgcatcctgccccccgccttttcataactttgtaactccccaaataaagaagtactggtaacaatacaattattgtaatacatccctgactcatacaaatgaggatagaaaatgaagttttgccaaacccaaccactgttctcgttgtcagcatcattgacaactgctgctccagaaaagatctgatcaccaaccagcagggacatggaagccactgctgccagaaaaatctacctatctttagtatttcctttcttttattaagccagactctgtttccttctgaggcaatggagaatatgtttactccttatttcaatatgctgcccttcaattattccaagacaattttgacgttttccctgaatcttccatttagtatagtggttaaaagcatggactcaggtgctacactgtccgttctaaaccctggctctgccgcttatgagctgtgtgattgtggacaaagtaaccccttattgcttgaattcatctataaaatgagggtagtagggaaactgacttcctgggttatcataaggaataaatgagttgattatgttgtgtctagaatagtttttggaattagtaagcactatattattgtaaactatcataattaaattatcttcagtttccctagctattttccctcttttatggtttcaggcatcctcacaattcaaaccactctttaaacaagttcttgctgtgctggaaccacaattgtgactacggaattaaaggaatgaactgagaagtgcagtgtatagaggcacactcacacatgccgatcacctggatgagaaagaagggaaggcagactgatggagtggccctgctcaatttctcagggaagggaacaaaaatctatttgcaggatacataatagaactatcaaaaccacaagaaatcagctatgtaaatttcgaaatatgagttattttattttgcattatgccaaaaatcacatttaaaaaatcaagatagatagaatatagaaacaatgacaaaccaaataaaataagtacatcagtcatcttataaaagaacctaccactatggcaccaaagtcatgatcaaagtcatctgtgacattttccccattcctaccattcccctttgcccccacatgtattctaggctccgtagtagtttatccctaaatggccctctgattcttggcagctcactacatatatttgagcttacaatcagaagctctggatctattaataacataagaaaaacaatatagcttattatgtgtgtgggggtttttttgcttatatcttaattactagttccctgatctattccaatgacaaaaaagtgtttctataacattacttattatattataatattattatttttttgagacagggtctcactctgtcacccaggctggagtgcagtggcacaatcacggctcactgcagccttgaactcccgggctcaggtgatcctcccacctcagcctcctgagtagctaggactacaagtgccctccaccatgcctggatcatttttgtatctttgtagagatgaggtttcagtcgccattttgcccaggctgatctcaaacgcttgggctcaagccatccgcccgcctcggcctcccaaagtgctaggattacagcggtgagccaatgcactgggcccaaaaagtgtttttaacgtaagatatgtcttttctttgagttagtatttatgatataacattgtcattatatcttttgctactatgaaggtatattctatataagttataaaataaaatagcaggcctgtcaaaagttatgttatttttctctactaattttgaacagaacttctgttttatagttgggcagcacatttttttttctccatcaggttgtatagtacatgaatcgaaaggtttgagaaaaattctgttttactcaaaagtcagttgatcatttattttgtgttttctaaatttacgggaggcagcacaaaataaaactaatgtttttagccatcttatgtcaattttgatgatcacatcatcaatccaactctaagctgtgtggaataatcacagcttttatgcttttgagtgcagaaagagtttgagcattttctgcaagccgtaagtacctaaagatgtgtaatccatctgtctgatatcacctgccatgaactgaatggctgtggctcttctccagtgctgaatgaaaatgaaacagcatgacaaacatgtcttaaggaaattctatgaaacacggtcgctttcttagaggagaaaaaaaaaaaggttgatttgaggatttggttttgaactaattttgatgtctttattgacaatgaatgaaaaacacactgcaattgaaatgggagatctgggttagtattgagtctgctgctaatggtatgcctgtatcatctaacctgtctcagcctcagtatcattgaggcacctcaacacagaaatggctgcccttttccagatgggaatagctaatttatattaatacatacattttacttaattggattctcctggttggtttttgttttagaaataacattaggtttaaaatatctaatgtggaaatcaccgagtaattttcacaaattattctgatttatctgagatgatatggaacaaggtgccatcacaaaatcatgaaaaactttttacaaataaatagtcctttaccttcttatttacttatcaagggctggaataaagaatttgaatcttggtcaaaagaaagtaaaaacgtctcgttgaaattcccatactgttgtctctaagtcctcggaagataggctagttccagactctcagcttttcccctgcaagagaattagggtttgcccaatatttgggtaggctgagaaattaaagaatttagtgagtagagtttctcatggcttcaatgacaattttgctgtttggaaatccctcatagttctttcgcagttctcttttacttttttcctctcctttcttgtactctgtgagcttattatacagagttcttacataattttatattcacattagagcagactttaaaaattaattcttactgatgccttggtgtggaatatatatattattaatgattatatgcacattataatttattaaaatacataaaatttaatatatcaaattttctacagagctatctttgcaaggacaaaaaagatacgaaaaaaatcttaggagatgatctctttaactaaaaaccaaaaagcctgtggatgaatgtgtgtaggtaaagcaaatacatccctttgttaactagtaaaaagattatggttcagtatatcatatttgaggaataaactgcggaactccaaatctggaaaggatctcgaaatcatttatttggaaaatatttatggagggattctacgaatcagtactctgtttgaaccaggaacccatggtcacttccctggggctgagagtccaatgtgggaggcagatttttatacagataattataacacagttatatatggctggttattgtctgaagttcataaaaagtatcaatatgttcatcccagggaagggagagagaggtatggtttggagaaatttccctgaggaagtgatattggagtaggttttgtaggctagttggaatttgattggggtcttatggtggtagtggttgggaaaggattggtaggaagacacatcagtagagacacattgagcaggtggggtgggggtggcatgtgtgcagatgcagagacaagaaagagcatggagagtttgggagcaatgacaagcaattcattatgggtggacatcaccctgcacagaagggagtggtatgacataaaactctaaagttaggcaggatagatcactgaggaccctgtactacacacgaaagtatgccatggatggggagtgttatgatcaatgtgaagattggaaagatggtggcagtatgaagcgtggacaggcagggagtgatcctagagcagtagttttcaaatgttgtggtttcaggatttctttacactcttaaaatcattcatgaacccaaagaacttttgtttatcgggggacttagctatccatacttaccatattaaaaattaaaatgaaaaaatgtaaaaattcttattaactaataataagcacttgtatgtttatacagacaatagatggttaatgaaaacaactatattattcaaaacagaaaaaaatttaatgagaagaatttgtttcacatttagtcaaatatcttcatgtcacttaagagaatacatttagattttcataaatgcttctgtgttcagtctgatagaatatgttgttttattgaaatatatgaagagaattttcacgcatatgtgtggctggaaaagggagtgttttaattgcctttccaggtaactgtgaatatccttctttaatatcacgtcaaaactctacaaatggtagtttattaaattagttgtgtgaaatcaaaagccatatcaatgaacttttgatttatcttgtcctttgaataagtcttttacctaatcatgcactaattatttggaaaatggcacattgttatgaaggtcttccagattttgacaaattttattatataatatccaaaaatcgcatttgttactatcaccactaatgtcatgagaaaagttgtaatgtatgggtaggctgtcaagctcccagtggcaggtaaaagttttcccaaattccaatttcctcttgaaagctcgaattttgacattgacaacaaatgctgtcatttgcttttcctgaagtgacaggctttccctttgttcatttttgagaaaatgtgtgccgaatactcaagtctgaataaccatagtttgtcagttattctttcaagtgaaagtggtgttccatgaaaaaaagaaaagtggcttattcagctcctgactcaatcacacaagtgcttttcctagagacaactaggacacttcagtatgcagtcaaatactttatatattcctcctatttcatcatacagaatgttaaaaatatgtatttttaggattgtgcttgaatgaaattaatatgtactgcttcatcagagatgtattatgtgaactggcattatttttcttactgagagtgtgcagcaatgaagaaaatgcagactatgcctatagtttgatgctactgcattgattcctgctaaagcattagcagttttagcacatgcctattgctttatcagtgcaagtgccaaaacagtgaaaaaagacaaatgccattttggtattattacgaaagtagtttagagctcaaagctcccacacaaagggccccaggaatccccagttgtctaaaatctatacttcgagaacaactgccctagaagaaagcagttagtcaccactcaatagtcaaaagaagagaagtaaaagatctgactatagctctggtaccaaaaggcatggacttagaaatcagaactggattcaaggcctgactctgctgtgttcctgaagcttttttattctttataatttccctagctgtacaatggagataatcatagttcatactttatagagctaatataacatttaaatgagaaaatgaacctaaagggtgagcacagtgcctggaatacattaatagtaggccatcaataagttagggagaaaaaccacagccagaggagtgtatttaatgcacaagtataggagagagaaaaacaatgagattttgtgactgacttgataggagatgtgaattaaagttatagggttaagctcacttccaggtttccagcttaagccacaaatcgacattaacccaaatagagaaatggaggtttgtaaggcatgataataaattctgtttggaacctgttcagtttgagatagctgtgagacatctggatatagaattaaaatatggatctgagactcagaaagctgtctgggctcgggtaaagttgattaagaagttactggatgagtctgggcatggtggctcatgactgtaatcccagcactttggaggctgaggcaggaggattgcttgagcccaggaattcaaggctgcagtgagctatgatcttgccagtgcactccagcctaagctgcaaaacaagaccttgtcaaaaaaaaaaaaaaagaaagaaaagagcagtcactggttgaagctgaagctaagaatattcacggcattgcctaaggaaaaaaagtgaaaggatgatgagtgaagaggcaagactcacacaactaccaatttttaagtaaagggaacagagaggatgatagacaatgaagttagaacaattacctagatgccaaagaggaatttccaagatgctaattaaaagacatacttgggatttaacaattagtccaactctctgcctgtaaaataaatgaagaacagtcccaaagaagctaagtaatctcctctaaaatgtctactgacaaacacaaattatgaccttttctattatagttgacatatttgtcttgaatcttactattatatgatttgctctaaaagatctaagctgtatataaataactacagaaaaatagatttgactagttcatttcagttttctagcctcacctatcagtgtactatgatgctaacataatcttatgaaagtacttgaagccagccaatacaatgagtacaagactaatatttgttaatgaatcagaatctagaaaaatagcattgtaaacatttcggatatgctgtggtgttactaaggaaaaatttatttttttccattagtcatggcctatgggttctcatcttgcctaattttccagaacagcagacagtttggcaaattgtattggtccataacctgtagtattagtagtgtctctctttccctctctctgtcgggatttttatgattgtgttgcagtcaaaatcgattagttctggtctgtttccatggaaacaagattgtgtcagaaggctgtaaatttttcatctttatggatggaaagttgctgtatgtcatacaacttgagatagcattaaaaaaatctgtaatgtattttcacgtctttgagaaggagagtgtgagttgctgtgaaggactgggtccattactgaggagggatgctgtattttcttggtatctacaagagactattatagtaagggtataaggtaaaagacaagattgaccgatgaattacctgttgaagaaaattagttatttttcccagtgaaattttcactgagagctaatgattgtctgttatttaccatatattctcaggcagcatatgcacccaacagcataagatttatcaaaggcatacatagagcactcagcacattataatgataaccactggacacattccaaggcagaattaaatactattttctataatttcaatagttttgaaataacaccttaatcagggggctgtgaagattgaataacaataaacaaaattctattgaatgattactatatctcagacactgtcatgccatatatgcatgttagcccatttaatcactgttacaatttcatgaggttgataccattaatatttccactttagagatcaagaagcttaggtgcaggtagactagataagacaaggagccaagatttaaacctgtctagttcagaaaaaaaaaaaaaaaagaaaaaaaaaaaaaagcctaggtacctaagcctgcaaaatgagaagattcttgatgtttgctgaaacaaaattaggataaatcagctaccttactgggaggttactatgtataaagccctgtgtcaggaatgagtggtataatctaagaaatgtagcaatatagtccttatctttatttccacataggagataaagcaaacaggaatgaattaataacaaacataaaacccacgtctactttcacatgtatgctacacactttggagttatttgatgataaattaaaaacctaggctagcttcttctatgtcaggtacctcttgctctcagtgtgttgtcaaggaaatcagcattactattagtctgaataaatctattgagaaagtaactctacagcaagggtatcactacgttatagccaaacacagatgaaatctagaccttctttatgttattgttccgtttctattagctaaacacatgattgccaacatgtgttaactatttaacgagatgatctatttctgtttttctgtacctggactcaatgtcatggctctgaaaaaaaaaaaaagcttagtaaaaaaagcatgggttcatctctatcttcaagataattatcctggaactaattaatttttaggggttgatattttctgtgacttcgtccttatcagatagttattagcttgaagagacaactgctaactagtaacaaaaattaagtcaacattttaaaggacaaatcagcatcactggatttattatctctttaatgtttctattaaatgcttgcaaagtaaactgtgtgtttgaccccccagtattcattccattccagatgtttccttcaagtcccttgcccatctttgtttaaggaccaggtatatgatctaattctggccaaggaaaggtgaggggacttcagtcaagtcattgtctgtaaaaagtttcttcactcccaagaaagagaacaaagagaagatagcattctctgtcctctggacccttttctattgggataaaatacatggcactacttcagccaaattaaaaccagaagagatgccaatctgagagcaaagctgacacactgagggtggcaggtcacagagacatatttacccctgggcctttgatggatcactcagcttgtggacccgaacaacctctgcactgcttgttctgttcaataaacatctttcttgactaagacagttttagacagtttttctagttagttgcagatgatacaccaaataaataaatagtctttggtcagttcaaaaacttgaccaattcagaagccagctcacaaccaagtactcaccacatatttggatgatctttaccccatacagtcaggtgagccatagatccaattaccaaataaatataataaaatttaaagtaaatacagtccagggtaatttactaaatagacaggatgaatgtctctcttaaaagaaaaatatataaaaaactcagttgctgggcgcgatggctcacacctgtaatcccagcactttgggaggccgaggcaggcagatcacgaggtcaggagatcgagaccatcctggctaacacgatgaaacctcgtctctactaaaaatacaaaaaactagccgggcttgtggcaggcgcctgtagtctcagctactcaggaggctgaggcaggagaatggcgtgaacccgggaggcagagcttgcggtgagcgaagttcatgccactgcactccagcctgggcgacagagagagactctgtctcaaaacaacaacaacaacaacaaaaaaacaaaaacaaaaaaaaaactgagttaatctctctttcttacatcaacagcctttggcatcattccattccctaaggtcatctgtgctatgtctccctgtatgtatttgcctctttggaagaacaaactggtagaggaaggaagaaaacacccctctgccttcttttggtcctgatacagctgtccttgttaaatagtagagattttagtttattttccacaaaaacaaacttatacccagaagttgtttagttaccttagatagtcacagcacctttttccggaaaagctccaggtcccttctgtgaattatctcatttattcttacaatatccctagaagagattctttgctcctttcccagtaagccactctactatgaatccttgacaggtatctcatccctgtcaaaccttgatgtggcttggcttcagttttcttgctccataatctctgtagaaagagaatacaggtgaaattagcctataatctttgacatttggcataggggtgctctggctctgtgtctgggttttattccttttttttttatggccctggatcgagaaagcaaggatgatgcaaagcaagatatttgacccttgttaaaagcatgccctagcatgatttaggaagaatgggaccaggaaccactgccaggatcctagggttgggacaggggtgctcccccttctttggcagccttgatccatttagtctttctgaaggcatgctggcactcctgagcatccttctgttcttccctcttgcttccttctctcctcttccctccttacatcttcccctttgcttcttttcctcaaacatctcaaagaccaaagaggtagactagtggaacatgtggttcacattggtgttgtaggtcattttctagttccttctcctctccacctaaaacccagtttgattggcttactaaaataagataaataaacctatttagtagcttctaagagtatattttagacaagctgaggtaaaaagccagcatgctaaatattaacctaaatgtaataaccagatgtcatacttctttccgctataaccaacagcaatggcttagcagagttaaaccaataataataatttcaaagggcaatatatataattctaaaatcagtaactgacatttaaaacaatatttactgcaattcatttatacaatgctcataagccaaactagtcatgaattctcaccagtaaatttcccttggccacttaccataacaaaaaaacattaaatctcacttttacaattttatacatggtctatacaatctttgtctccagatgaactctctcctaagccatcattttttttctctattctgttaccggagtgatggtttcaaaacacatatcctacccttgttcaaatctgtcagtggctctcagtgactcagaatcactttagcaaagtatggaagtgccttcatgatctggcctctgcctctcttctcttacctctcaccaagtggtaacaataacacaaatgctaataataatacccataagacacaccttgcatcagaaattgagcaatagattgttacataaatttataattcttcaataaatgttagttccctctacttcacagccacaagcttaataaatgttatttcccttgtcttcatagtacacaagtaactaagttttaaatactttgaccttcatcctgagctataatgaacatgatgttaagtatgttaaataaccaaaacatcaatttcaatacatttttaaaatatttgagagctttttgctgggatgtggagggggatgaggtagggagggctggatatcgaagagggaataaggaggagcagaagggtggagtttgaaaaagcatcccagaagtttctgatttgcttgagttatctttctttttcctacccttatgaaaattactgatttacagattggagaaaatatattttatggccttggcttcaaagaggagagagtatttttttttctttttcaatcccaagtatccatgggaaatcgcagtgattcctgcatgtggattaatacttcactttaggccacatacttcaaactgcgttatatcttaataagagttgcatctcacttatttttaaaagcagccctggcttacaaattaactattatataaaattggactctaagcaattctgaacttcagtgagcataagaatcacctgtgcagcagggcgcggtggctcacgcctgtaatcccagcactttgggaggccgaggcgggtggatcacaaggtcaggagtttgagaccagcctgaccaacatggtgaaaccccgtctctactaaaaatacaaaaattagccaggtgtggtggtgtgcacctgtaatcccaggtacaggtactcaggaggctgacgcacaggagaagtgcttgaacctgggaggcagaggttgcagtgagctgagatcacgccactgcactccagcctgtgtgacagagcaagattccatccgccccacttcaaaaaaaaaaaaaaaaaaaaaaagaatcacttgtgctacttgtaaaagatgcagatttctggattcaatttctggagattctgcaaaaagtaggtctgaggtagggtcgagggatctgcatttttaatacactccctaagtgagttttgtgcaagcgatgcatggatgactatttgagaaaggatgaactaaaggaatgagtaaagaatatgatctgagtgcttttggcaatcaagcctggaattttggtgtaatgtccccagtaactaagaaaaaattgaagcatattggatcacatgaattttgttctattttaggaaaaaacaaaacaaacacatttcctaaaagttgtatataaaaagcaaacatttttcaagaactaaactgaagggtggaaattttgtttaggatatagtataaaggacatgaggcaacatgctcaacagacatcttaaattttattttgcacagatgtgtacaagatgcaaaaaagtctttctctgatggttgcaattagttaaactaagtgaatttcatttagaaggtgatgagataagatggtccagaaactttgctttcagatgacctaatacatttattggatctggaaatcccccaaaaacggttagcctgcatttgaaattatcttaataaaatttcagcattttagtaatttaggagaaattctttggttttcaaataaggaagtgatagctcaaacagcatgatagaaattttaccctaaaaatgctagatgtcaccagctgaggaatcttagacaaattaaatctttaattttatttttcttaacccgtttctacttagtattgttattaatgcttatgctaatatcaacaattgaatattctagaggcaagtttgtatcctcttttgtggttattttagtttatcctgaaaatttatttatcctttaagatcttctagttcccagtgttgtaaaatttttgtcttactatggctccattattttttagcatcattttgcatctttactctttatctctggccatggaagcaactttattttctttcaattgtttttatcttcctttatactgatgacatgatatacctgcttaagaatttttcaggttacaaccatttgtgtcatgcagtaggctgtaaaattctggctgttcagcattttgcacaagaacagaagcagatccaaaggtggtcatggaggaactcacaagctttgccatgaggaagggacagctttccatctaggtgggaatgtggttggcttttcaacctctgtgatgaggtaacagtctcaattaccatctgctcacttggttttaagacttcaggtccctatgaaagaggtaacttcaaatgggcaaatcaccaagatattagagggtgaaatattgaaatgttgtctaggaagccaagttgtccattcagttcttggggagctccagagattctccttgtagtaacttcgatcaccttcgtggtggttcatgttaacttaaagtctgagacttctttctttctttgtgttgtataaaattcatttcttcctttaaaaatgttgagctcaggaggctgagagctaagtgtacattttgaaagagtaaattcattagcctacagtccttaacagatgtatcacatacattttctccattttccttgtcttgagattcctattgcacaaagatatatatatataactttatatatataactttatatatataacattttatatttatatataactttatatataactatatttatataaaactttatatatatataactttatatatatatatataaaactttgcatcactttttagaagaggtgagatataataaataaaaatcaagttcctctatgtgatttaaaaggctttttcattctttagcatgattctatacttcttataaaccatttttttctcaaggactatacttaattttataataaaaataaatattaagaaatgaacttggaagcactgtatcctaacattgaaaataatctttcaggccatctagtttcatcaacctagtttaaagcagtggttctcaaaatttagcatcagaatcaccgggctaacttcttgttaaaacacagctttctgggctccaccccaggtatatatggctgggacccaattttgcatttctaacaaatgcacagataatgctgatgttgccagcccaggaaccacactttgacaatacctagcttattgaatccaggattttacgttgttttttttttttttttttcaggttagaaacatgtatactgggcatatcactttcatttttgcagtttcttaaagatgacaatcatagcttcttcagtctcatttatttattcatttgatgccctatggtgtaatttcgctgcacctggaaccttgaaatgatttacagcagtattacacagaagcctgcaattgctttcagtctccctgctgccagcctgactcccatatagcctgtttttaccttgcctgtcagagtgatttgagaacatagaaatcgaatcatatcattcctctgctcagaagcccccagaagctacccagaaaaaaagtcccaaatccttacaattgcctaaaaggccttataatctgtctgaccttttggttatctagtggaaggcacctccttctattctcctcctccctcagttctctgtagcctaactggcttccagctgtcctctgtacctggaagcacacacagactattcccttattccagtatgctcttcctctaggaagctgaatgactaactcttctatctccttcaagtcttggccaaaagtttactgtcttaaagagacctgctcacacttctcctctaatctcttaccctgctctgatgtttccaagtcacttatcattttgttaggtactatataacttacttataatgtttattattcattttatgtctctcctggatagcacagaaacagcacaggggctggaatatttgcctttttggggtctattttcaccaatgaatctcatgtgtctagaacagtacacgcacatagtagtgctcaatgaatacttttttaaatcaatgaattatttaattttggtttctgaaaaatttagtagtttttttttttagatttattatttggaaattcagcccaatctttagaaactcacatattctatttatggcaacatattttataatagcaatgtctagaaaaaatgaaaccatccactaatggggtattgattaagtaaatcagataactttgttttgtattatatagatattaagatgataaaacataaaaggactcaatataggaaaaacaaagtcaaactttataggcactatatttattaattatgtagccttatttaatctaaatcaaaatacatacattacaatcctctttacctcaaaaataattatataactatgccaagtttactagactctcttgaaaacaaagcaaattgaagactgaatactttacctaaagtatttcccactctaaaatatcttaggaagtaagaatgataatagagaacagtgattaagcactggtcacttatcagggactgattacttcatttaatattcataacaaatatataagataaacatgattgttgtttgtattttttagataagaaaactataatgttcagaggggacaagtaacttgcccaaggtcacatgactagtaaatgttgccatcaaattctataattttttctttgggaaaattaatcaaagcctctctacaatgatcttaccaatgaacctctccagctacatcttacatactctgtatatttccattccttaaaagacctcagcctctgacatctggcgttcaaaaatgttcacgctgtctgaaatatcattgaccaccaactgtcacctcttaaaatcctactaaaatttttacagtaattatatatattctatcttctgttgttattgaagatgtgccttattgcttctacatttattattaaattccttgaggagaaggatgtattgactacctaccacagtaagcagggcattatcagatatatggtggatacaattgcccaaacaaatcttgcaaacattctgttcaacgtggtagccattgaccacatgaggaactgagcatttgaaatgtgggtaggtgccaaatttcaaaatgatatttaggacatatcatcttaaacaaaatatatcattaataaaatcaatcttattgttttctttttttgatattaaaatctagaacatttaaaattacatacatgggactcattatatttctaacgcactgtgcttttttcagatatacctgttccctactccatcactctcctccaagggatcaaacccatgaacaaatgcatgaattaagcaagaggcgaatcccttattctgagatgttctacatgggggagggggctgtctctggatcaatagtttttctattttatgtagtcaggttgctgcttttgtcttttggtctaagaaacaccatagtgaaaaagctacttggtccataagtgaacattctctctctgtgtgcgcagtggagcagaaaccacatgcaaatcagaatataacagcattacaggaagctttctattttgaagtacattggcaacatgacaaatataaagcaaacagcattctctgaacaatccttgatccctttcctaccccaacatcagccataatagacagccctatgtgttgccctcagccacatgtctcctactgcttgctggtaccatgtgctttaggcagtttctttccaggcaaacacagactgtttactgactgtaatcaaaatgacagcccactgttttcacaactgagtgttgagagtcgattgcctttttcacttggcaacctgaggaaaattgagaactgggaacttgaggtatgacttacattacttcaagatggcggtgttgactactccacatgttatctgcgctcctttgagatttaaaatacagaggattgggatttgtctagctcagagcaaagaggttttaatcactgctttcagatgggtgcaaatggtaaaccacactggagcacaggatgatttaggtgtgtctgaagttcagctgccatttgattcttcatcagcaaaaaaccaatcacataaagaggccttccccactaagcaggccccttagatacacagttataatgttacacagtggatcactccaagatggtgcctcagaagataatgcaatatactagaaaaacatgcccctgccctatctttattagaaatgagatttaatgaaaagataagagagaggaaaacagaaggagagatatacaagttgcaaatcagacaaactattctagacttgtctctgctgtcacttgtgtgatatattgaacacatgagatctcagatgtttcgtgtttatgtgagtaaaaaagaagggagaggtgggaaattgaccagttaatttgtagtacctcttttatcactaaaactctagttcagtgtccagactttgggactctgtactaggcttactccaaatgtttgtcccttctgagagaaacttctgagggtatagcaatacccttataccctgaacgtgggtcactaaaccttatataaatcatgttcctgaggtaggtgtgtcacatctattagaggatatattcatttttagaagactttagtgaactagatgcttgcataggtcctctgcagcccaaatttaaactgtttcttgataaataatataaatgccttgagtagaatataacttgaagatcagttgctgaaaagaactatcccttgaatcctttctaactctagatattcaattttgtacacatgacatcttcatgaaatggtaatataaaaaatctcctactgagaaattccatacaaattgcagttaaaagaaaaacctagaaaactttaagtctggttttcagtgaaatatgaccagtcacttgaccatatctcccccaaaaagggccctttgaaataaagaaaagatgaaaaaaaaaagtctttcctgggatctgaattcaggacccagagaatctgtgtttttccttcaggctccgagcacatcattggcaccaaaatagagcaaaggactgtgtgcactgccctgatttaggtgtggatgatgccacttactgcagcggggaatgcagagtaaaaggtctctgcacataaggacaggaaggggatgctgttcagtgctcaattcttttgaggctaaaggagatccagaattccacaggtaagagaaaattatatatgataaaaaattttgttttaaacagggattgtagcaaccaaactgctgaagactggcgtggtctgtctgtcttcaccctccagaggatagaggacctggtaagtaagaaactgactagtgagggcagtaatcctgaggagaaacctaagaagaggtgagagggaagatgccaggagggagagatgccctgccgtgtgccaggtgtgccacctgagctgtctcctcaaggacatggaggattcaggatcctgataaaattgccagtgcaaaatcagacattgagttcactcattcttcaagtgtcactcctctttaaaaattaacagactttttttagaacaattttaggtttacagaaaagtctatcagaaagtattgagttcccacatcgagtgccctattgaatgtcttaaatatctgtcttcaaaatttttattgagaaataaattgagagaataaatagaaactattttgttaagtgtgaaacttcccaaatttagctttcttgagggatgtgtattgttgggggagaggaggaagtgtattattttctgattaaattgatctcacagtgttttctgaactggcaccactatcatagatttaatgggatatttaaaagaaaggtgtcttacaatgacaggataattttaagatactgagtagaaaaccattccttaccaatgcataagagggagctgactattgttttcatggtgtatcttaactctagtgtttatttgcatgaaaatctgcatcttgatttggatgtgctctgccacttttcatttaccttcatgctttaccctttccttttcaaaatgttcaaagtgcttttgaataaggagttggaatgtttcctcaaaagaatctagctagttcttacaattgtcatcatgttggtagaggggaatggttatatcaaccataaattattccccctctgcactgattgtgttatttaaggtgacccttcttcataaaagcattcctcccctggttcaggctttcattcttatcaatatctcattggtttcttatttatattttcattgcagacttcccaaatcctttgtgtataaaggttggatttttttttttaaataaatgatccaatcccaatgggaggacacaagcactgtgtcacacacattcatcataaccctggcctcgaacatgataactttgcaattccttggccagtatttcttctgtttattacagaagcaccagcgacctgcctcaaaatgtggatattctcatcttgagatttaacagatattttctgttatgataatcattttactgaccacgttggcagaatgttagagatgggtgaagaaagcatagttaaatactaatactaaatgatgatcctctagggaaaagactttaggatataatcttctctgaaggacctgtagaggattgccctctatgtctcctacccagctgtgggaaaccaatccggaacagcaactggggtgttaacccaggaaatgtctccttaaaagctgactcatcttaggaatgagattctttttaagaaatgcaattaattattaatttcgctccactattagattaattcacttctttctcagatatgccattttctgaaaatatcttttaaaatgcattttggctttaaaaaatatgttcgtttacagaatctgcctttcctccagatctgcctaaattgcacttttaaaaaattaaaaatcaaagtgttttgcttccaactggtgatttggagattcaaagaatatctttcagtagacctactcttattcgattattcaagatttagttctccagatagcaatttgtaagtaagaaataaatcagtgagtgaatgtatagttgtacaaacttaaagttatggatgctcagctccaaatgtgtacattgtttgtatggttagcttgcaaaatataccataaccagtagctgaatcaactttcaaatatcattgggataataaattaacaatttcaaatgtaaaattatttaaacacataaataaatgccagtgtgttcaaccaagggagaaatggacacaagtgtattttttgttgcttccttaagtatttgcataatatctttacttaacacatgcccgctggttagcactttgaaattattttgaaaagcgtttgtcaactatctttcacttccctagccaagttttcattggcttctgttatttttctttgtctttctctagtcaattggttttcaaacctggctacacatttgaactacaattgcagagcttttaagcaaatattgatacccagattccgcctcagagaatctgattgaattggttgaaggtggagccaagcattgctcttttttaagttttccaaatgattctaatgtgcatccacagctgtgggccactctgtgaataagctgttaatgttctacccctttttgttttctttcagtatgtttgcatatctctttctctttagctgtgttttttttttttctcctgacatttttattggtgaggtcctataaatctatttttttcttttctcattttgcttttttcttttttacctcctatttactggccaagaagttctcattccaggtatatatatttgatttatattcttatcccatactattcatgctttatgtcagtgtaagagaacacaatatgatggtgaattatatttttgcctgttcttccaaagctaatttaatagtttacattaatttttggtataaatataaaaagatcaatagtagaaactaaggccattgtcaaaaacggatattaaggaaggatttattttaaatgtagttattattggctatgacaaaagacaataaaacagtttagaattttgagaccatacaggtctcaaggacatgtatatatcatatcaacagtatttttccctttcagaggtaaaggacggcaatgtgtttgccctaaattttaaactttaaaaacaaatttcaatagtatttaaagaacagagtggaagtgggaatattacatattgcaacaaataacatagcagaaacaagatatcactagcaacagaaaatagcaatagaaaaaaaagaaaaaaaaagaatcaatgctgctaagtattgtgatgatgttaatattgggaagaaaactagaaatcaagaaggtaatgcatagattcaaggatttgaaatgaaacagactgagcctagactaggagaaaaggaatctgagtgccaatgtagctgtgcttctaaatatggtcaagaggtttcctctccatgcggtttattttccccaactggcgaaaatactggttagattggcaaaaggagaaaaagaaaccttgcaattccttggccagatcctgcctacacatgtgttttattgaatctatctggtattataaataatttgaaatagatgattccatttaacaacagagggaaatatttactaacaatttggatttttcagcttcttcagggaagtcatttgatgtaacagtctcctagcagtgagaaggcgttttccattttaaaaagggcatgcattcactttctagttcctcaggcccaacatgaatggctttactgctttctcttacctactttgcccatgcaggaatttatgttcgtttcttctagaatttattatttaaggtcatgaccaaccattatataaattccatgaaaagaaaatgctcagagtacttgggaacatgtttagttaggcataataaaaacaacttatatggagaaaaataaatgtcacaagcagaaacaccaaggagacagagaaactaacaaacaggtgactagtcctcaaatagaggcttaagcccacaaaacgtgtcctattaaaccttatgcaagaatatgttggactctagaccagaagcgcaatgtcacttgttagaaatatgaattggaatttagtgaattattccagttcaagctctttcttgggaaaggaaaaggacaaaatgttctgtacaaccaaagtaagaataaagtatattctgaaaatcaggagattaaaattcccaaaagggagcttcttggcagaaaatggtcaaagttatttaaagagtgactttgaattcacccattgaataaaacaatattaaaccactatttaataattaagggaccatcatttctctaactttgctccagcacagagtttaatcacatgaagggctccctatatgcagtctccaaaaaaatgaaaacctaattcaattcttacagaaataactccagatttcataaggtttctctgaactaaaacccctgaaaattcatttatacaaccacacccagcatatgtttacatgtgctgtattttaatattgtaaacttgcttgcaagttacttttcagttgttctttattcatagatcttgggtaaaaccttctttaaagttctttccagaatgtcctttatcatttcaaatccttacaggaaagaagtgggatattaaaaaaagtaataaaaaaaaaaaatacttggcacattgaaacttgtggtatccagttaagtaggtattcatataaattttaaagaattattctactttaacaaattatatttctgatgtagattcagattttaggtatccaaagagctggtgcctatcaggaagttaataaaacaaagtatgtctgtgcttagtaaaagagcaagattttatttattgctgtattattaagaggaaacactattctgctccgaaataggtgtctgcacttgttacatcccattaaaatataaacaaagaatgtgttaatttcatcccagagggaaaaatattttcaggtaaagctgaactaaaacagtagcttctcaatcaaagataaatgtgtgaaccgacaatataaagcaagaatatgattttctttcttccaaattttctaactacctcaagttacaattgttcagtctacctcaagaagtaattcagatgtcaggttctatatggatttgccatgaaagttgtttataaggtaaaacgtaagcatgacattttgaaaatgaaagcagttagaattaaaattaatcgaaaatttaaaacgaacctaaaagtacagaaatagagttaagtaattatatttcactggtaggtgggtaattaatcctcacagttttggaaaactggtaaaacaaccattaatattaaggtgcgaatgaataatatatttttaggtgacaaatgaaacatgaattcccaaccttcagtgagttcatgtttctatacataaatgaaaatcagaaaaaagtaatcttcacagctacctatgtaaagaaatatcactatataatcaagtgttaatttcttggtgaaaaaaaatctttaaatgcttattcttatggatgcttttagttatcatcaaccctaaagataagaactcgtaagagctgggagtgacctagaactgagagacagatgagcaacaaattccaagcaccgcatttgtctagttgagaaacactaccctcatatttttaagcctcccaagctcttagccctctcagatctgcctaatcaagagtccattaagtcatcttggctgccatgaagatgaagctgacagcgcagttacttgagtcagtttaaagaggcctagggtggttgaagggaaggattaggaggcctggggtgctgaaaggtcatccaagttctagctcccaaagaccccagtagcacacagctgtcaggagcacgaagctacacttagaaacaacctttggaggaaagcagggattttgcagtccatcaaccattcatcaagcacaatttgcctttccacatcttattgtaccgttaatagaattgaagcattagagagtttgtgagttgatcacatagcaaagactttcctgagatttaggttcagttatctggtggtcttagtagaaattacttggcgtttaaatgtggttttggtgaaacctagattccctttgtgaatctttacagaaacttcgtctaacaggtatatcctcttaaggcaacgtgaaataaggccctttgcctctattttcataagaagaagaaagttttgaagtccgtgataacatattgggcataaataactgtcttctggaaggcattatgagttctataaactctccaggaattgcctggaatgttaacactaagtgatactattataggtacacaattgttgttgtttcagcaagggcatccttccaggatgagaattattcacttttcaggtacataattatttggcagttttattctatccttcctgttgtggtggaagatattatatcaccagcactaacgataacaataataacaatgatgaaaatttatgcctttatgtttgtcctgttccttttgatgtgagttaggatggcagggagagagaggaaggaggttcgtaatcatgttccaggatctataccaagcactgaacagacattattttagttacacaatcctgtaacacaggcattattattcctattttaaagatgatgtaataaaggctcagagagtttaaataacttgtcaggtaatagtggccataaaatgtaacctgccaagctcttgctcttaaccacttctccatgttgtttcctgcttgtttccactacagaaggaactggccaagaaacgcccctatttctctattttaccactttcatgtttagcacatcaatcataatttacaactcagtgagagtcaaagttgtatcttaattaagctgagaaaccaactgaagaaaaatccaaataaatgaggatcagaaaattttaaaaacaaagtattcttatacagctttgattctaatttccttcctttgtaggcaaggaaaatgctcttcagtgatacttggggtcttttctgagacaacaaaactcactagtagcagaacatgaaccagatcccaagactttcagctcagggttcaacctttttatcttcagtactcaaataaatcacagcatttttctcaactttacaaatgaaatcaccactacattcttttaaagagtaagttattcaaatgtgtttgatatatcatttaatcaaagcaggtttaatttccgaaatttttgaaagagcgcattttgtgaagtgaagaactctgagtgtatttgctttttcacatggcgaccacatgtatagatgaataactaagagactgttgcaactataccaagaaaaataaaagctaacatttggggccaaaattaagcattcattcataaatgtaaaccagttcaatcaagaccagctctgatgcttactcagaacaaagttactcacatttagtcacctgtagagaagcatggtgtgtacaatacactcaagttaattaacagccatttctgggaaccctgtccaaagaaatagttttctttatctcctatggtaggaattcttctgaaatagacaagacccagggctctcctctcaggcaaccactattttgaaatgtttttggggggactattattgctactcaatgtaaaatattaagtgagatgtcaatatttttcaacatatcattaggaattacagtttggaggccttaagttctatttttgaagcccttttagccagtactgactggaagccctgttgaaatcagaagtcttcatttcatatagggcacactctatttggagtgaatgtgatgaaatgtttccatgcaaattcctacaagcacttatgcctttatctttgtcctcataagccacattatactacctgttgtgtattttaaaaccctgtatgatttttaaaacttatctttcaattaatatgtatagattttctgtcaataatttcttattctaattatgtggtggctaactgaatgaaacatttatggttatgatatagaatattctaaatacaactacagacaatatggatcatagataaagtaaattattgttttatggctccagtggttcttcctggtaattaataaaaataaacagttattaaatatatacagaaaaacagcaatctatcaagcttatagaacaattaagaatatataataatctttaaatcaataaattaaaaggtaaacatttaatataaaatgaatatattaaaggataaagaagtagcatattatggaacatatagagattattttattttttgaaggttcaacctcttttaaatggttagtattggtgttcttttctctatgaaaacagattttagagaaaaatgatagtgtatttcacaaagccaaacacctctatattgttatcactccctatatgcatggcctctctaaagctgttaaataaaaaactaaagcacaagaatgatagttccaatttcactatacatttatgtttaaaaaatactggacacactgggcatttaaatagatgacatacagccaggaaactcattagactagctttaagtataataaaaaatattttttctgaatacaattaatcataagcatctacaaaaacacaagaccattgatgcctagtatgtaccataaatcaccatttccagacaggctctattttctttgaaagataaagaaatagtaagcagtttacacatcaaacgatgcctttggttcctgtaatttacatttaaacaacactgggttaaaaatagcagcatgaagatgattttaaagtaaggaaaatgacctggtagctaggttctatggtgcagataatgaaatgttttgtcagcttacctgataaaacagagccttatgaattacagcataacaaagcccagcatccaagatggttagggtataacgtgtcttcctctgcagctgttcagcttttttttttttttttttttttgaccacagaggtttacaaattagttacaattttttttctttctttctctgtggataagaaaacaaagagacctttccagaatcctctctgcttatgcctccgcttcctgttctgagattcactctatggtacccaacatatatcagaaaacagctttgaggaaaaaaaaaaagaaagaaaaaaaggccgatcgcactcaaagtggtaccgccatctactggcggacacacacaaaattgagccaaagaaaaaacattcccattatcctctgtcacagggaggaaagtaaacctgcatgaagcatgggtagtcatgaaagtgccccaagatgacagtagagaggtgatgtgagctaaaatttcccaacacactaaaaaaatgtaacttatctactacatataaatatgtatgagaccttttacatattcagttatttgcatctcactaatttttttaaaaaattttatcactttgttgttttgcatgattgtttcacacataaactactaaaattaaaagatatataaattactgtttgaaaaataggttttaagtttacattaccctttacgtgtagagttttgcgaaagctcccttgtggcctgctctagtcttttgaaaaccttttctcttcctgggatgaattattttcaaggtgaggaatttgactccttagagaacagtgtaaacacatactcactgatagtatttttgtgttgctttctggtaaaacatttgcaagaaatatctaaatgtagaaaaagattctatacatcagtgaacctagctaatattatttattaggatattgaagcacacaatacataaagaaaataaaaataatccatcagttattaagatatttctcaatccagatgtatgttattgtttcatctgacctttcatatctactttagagcaaacaactatgattttattacagtttatcatcaattaaataaatacattcatattgacaaaccaactgtatggatggacaaaaatgatgtcaagtattatattagacttgaaaagacacagagagaaacacacagtgcctgccataaaggagctcatacaaagaagaaaaacaaatatagctgataccatatttcccagccatgtgttcaagaactgttaattacatacttcgttttcaattgtggcccccattttgtctaatggcagaaaaataaatctagtcagttccaggtaaactaaattacttgaggcttttcccaatgattttgggtttgcattcaaccaatacatgattttcctcttctatctctccttctcatggagactgatctaagttcaggattgtgtacatatatagagaaagcagagtatgatcccgttccccctttctccacatgggcatccactgaggccaggagtcctgcatgatccatgaccatcattatccctcatatctactaacgtacccacaggcccactgggccccgggaatagcatccctccagctttgcatggcagcatcccctctttgtcacttcttcctctaaggaaacttttgttcctgtcctttaggaggagagaagaaaaagcagcatgttcccagggtcactcttggctgtaattggctgacttaagccttcctccctgccccaggcgcctcacacagccatctctgttctgctgtttgtaaaccatgggatgtaatgcactctgcaggcttcaggcaagcgaggcacaatctctgccacactagaatagtgtaaatagatggaaacttctcatcttttcatctttttagctaatcctagattggcaaactatgtaaggagcccttatcagagactcctttccttcttcataacttccttcacagactcaaaagagtttttgcttgggtctcttctttctgtaccaaaggtaagctggagccacttgttttcccttgaaatctttttgtcttatgtctaatgtatcagtttactagggctgctgtaacaaactgccatcctgaggggcttagacacagaaatcatttttttcacaattctggctactcagaggccagaatcaagttgtcagcatgatcatgcttcctctgaaacctgcaggggaaggatactttcttgcttctcttagcttttagtagccccagatgttccttggtttgtggcagcataactccagtctctgtctctgtctttacatggtgcactccctgcatcactgtctttacgtactcctccctctgtgcatgcctctgtgtcaaattttctcctctttataaggacaccagtcactttggtttagggtccgccctcataacctaattttaacctgattatctctgtaaataccctatttcaaaataagggcatattctgaattactcagaattagaactttttgagaggaggcacaattcaacccctaacacaagaatttaaatataaagcacaagaatttgacaattcttctgtccatctccaacgacaattccacttaggcaataatagccttggctatctggccagaattggggagggtaggggaagagcctcaggtaatgatgaagacatttaataatattagtaacaataacaaaactaacatttattggtactatgtgccagacattgttctaagcactttacatatgttcatttaaacttcacccatatgaggtattattatacacactttacaggtgaagaagcaatgaaatgtgagggaagtaaaacgtagttagtacctgatatggtttggctgtgtccccacccagatatcatcttgaattgtcagatatcatcttgaattgtagctcccataatccctacatgtcatggggggcacctggtgggaggtaattgaataatgggggcgagttttgcccatgctgttctagtgataatgaataagtctcatgagagctgatggttttataaagaggaacgtgtcccctgcacacgttctcttgcctgccaccatgtaagatgtgcctttgctcttccttcacattccaccatgattgtgaggcctccccagccatgtggaacagtgagtccattaaacctctttttctttatacattacccagtctcaggtgtttctttatggcagtgtgaaaatggactaatacagcacctcacatctcatcccaacacaagcagttgtaatcgggtaagatcactcataatacaagcatttgtcagatgctgaaagaacacaaaggaaatcagcttccactaatttagatcattgatactcacacgtttagtgtaaatttataacatttcattgtttcattgtgtacactttctgtcatgaaagattcctattttctaggcacttttaactttttcttctctactcatgaacaaactagccctgctcactgtctctcaactaaatgttcattaagtgccagtccctactgctccacactcattttaccattactagtaatatttaatagaatattaattctatcactcagttttgggtatccagatgctccaaagagttttctgatgacgtcttctgaggaactgatttttcttaggttatactgggccacattttaatgagaactggtttgaacaaaataagaaaagtaaatgataattattgtggcgatattcctcatagaaaaaaagaaaaataaataaatgccagcaaagagagctttactctttgttgctgaagaaactaatttatcttgtcattaaaagtagaaaattatataaaggaagagtgaccagaggtgtggtatcatttgctatgattctaacttcattgtgactttcgtactttttttctgtagacagaacgacaggtagtttgcaaatcttcagtgagtggattctgagagggttaaggtgaaatagtcattgattaccaacataaggtctctggagccttagtggtgtctgaccatatgttgtaaacatatcatgcataaatcacagaaattcacactagaagagagctaatagcctccagctgggactcataggttgctctgtgcatgtctactgtttctgattactcaaggtcttcagagcctttgtgggtaggagctataatgctggtttctatttgattttataagcttcatagccaaagaatactttttgtaacatccatagatctaccaaaagattcccagactctggcccaattttcttgtttcctagaccattatttcccagacagtgattggaggaatactactgttctgctggactaatgaagtgccactccacatccaccagaatggctacaacttaaaaaggcttatcatactgtttgtgagaatctagagctacagaagctgtcagagacttcaggtaggaatgtaaactagtataaccacttagaaaaatggtttggcattaccaactgaacgtgagtctactctgtgagccagcaagtgccactcttaggcatatacctgacagaaatgtgtgtgtgtacaagaatgcctgtggaagcattattgaaaacaggtcaaacaagaaagaacagaaatatcttgaacaggagaatggatataagaattgtggtgtattctgaatctatagtatcatactaacatgaaaatgaaaaactgcagctacccacagaaatatgctggatttcacaaatctgaggctgaggacgaagaaggtatgtaagcaaaacattattaaatttaaaaacaggactgggcgtggtggctcaaacctataatctcaacatttttgaaggctgaagtgggaggatcacttgagcctccaggagttcaagaccagcctgggaaaaatggcaagaccctgtctctacaaaaaaaatgaaaaaaataaaaattagtttggtatggtggtgtgcacctgtccagctactcaggaggcagagatgggagaatcacttgagccagggagttccaggccacagtgagctatgatcataccagttcactgcagcctggacaacaaagccagattcttgaaagataaaaataaaaacaggttaaataaactctaatattggaagtaagagcattggtttctcttgagataagatagagcttttggcaagattggttgagataagggctattctgggtactagtaagatcctatttcttaatctgggtagtagttatataggaattcacttcctggtaattcattgagccaaacatttatgcacttttttgcatgtggattgtacttcaaatttcaaagtaacaggcgagttttttgacagttgtcacctctgaggaagaaaaaagtaatgaaaggtgaaataagtggaatttccaggatttgatctgtatatatctgttctgtttgaactttgtatgcttattagtgtaataagaagtgcattattagtgtaattttcaaaaaataaatttaaggcattaaaagtacagtaaagatgtaccttcatactatttgtacttatttacctctaagttattctctttttaagttgagtctaggatggcattcatcattattttaaattgagtctgtcctggaattcctcttatgccagaaggcctattcaagctgatactcagcttctatgcttctgtcttcagtcatcttagtaacaaagttaactaccactgtgtttgcatgtatgttaaataaacaaaatttacatgtcatctacaatttcacacctctatagtctagtttagatttgtatctcctgattgtaaatactgagactaactcacttttgcccactgcctaatatattatgccataaattacacaatgaaatacatgacctgacaaaagataataaaacacttttacctttgttacatcttcttcctttaaaacatctaaacaagttgagaagggtagataattttcagatttttcaggtgagaaaaattggtacagaaatgtgaaaattacatgatggttaaaaattggccaaataaaacaggataattgccagtttaaaatatatgcattagacaatatgattttatatcaagggctcatttcagatataataactgtcaaatattatttagaaggtgtgcttgattcagcaatattaaaaaattttaacctgtattataaaagaacaatagagtaaaacatactttccaagtggcttccagtatagattaccttctgtgctgtagttgcacagctatgtaatagcaatttttcaaaggtgttgggtcactatgcctttttagttgccattcctttggttagaaattactttcctttattgccattctcacccctatttccctccaacatctggaaaactactatttattcttgaaaatgcaattagggtaatatacttgatagcttgtcctgatctttccaagtgtaaggtatcaacttaactgtactccctgtcatactgctatacacatcattaatggaggaggtgaaaatgattcatccattaaaatgactgaatattcttaggtgcttgtaaacgcccattatttaccatggagtttcatcagaaaagacaggtgtgaagcagataagggcaggtactgggagatacacgtctctctgcttctctcaggaatgatggctggataatctgtttacccatatgcacacacactgtctactctagggctttgtgactgagcaacaggcttttttttccctatacattctttgttagtatgacactgtcagatcatctaagctaaagggaaaaatgtatttttttttcatgagttcctaacaccttttgctaattataagcaagcacgcaggcatttcccttatataatttctcattttatcttctaaaatttggtacatgtgagtagccaactatgtccaaatctttatatgattaggccaatatgaaaagaattaaaattttaatttaatatgctctcttttattttggaaaatatttacttgcatcatatttccagcttatattatatttttattggttgtttagcattctttaatactaaaacaataaaataggaaatcatgcttagaccacgtcttctaaatttcgaagacgtaatatgttgaaaagctttatttcatgtataatacattttcatttagtttatcaattttaaaagataatttcaactaaaaaaatccttcacagtttataagtgcactttattagtggagaaaatcaagggttttaaaacatcagagtaatcatgatggaaattattatacgttcatatttcagaaaataactactctttttttaattttacaaaggtaaattgacaaatgcaactttcccataagctctgaacaaaaagaggggctgttaagataagtatgaacatgggggaatcaggggaactgggaggtgctaatgaagaaaaagctagaaaagaatcaaagaactacattatttaaaaacttcatctattaggaagtggctaagaagaaaaatatggagagagatggaatgttactgtcataaacctgggagaagatgatcttatgcaaaagttaatgtaagcggaaatggacacaagtatatggatttagaagatattatggtttatgttgtagatatgaattttaatctatatctatgtgtgtgaaaaataatagatcaacagtaacttcaacttcagtaattactatagggcacctccactcaatgtatcaaagttccagagtcttgtgtaggacccaggtataaaggtagaggtgaggggctcaatcttttgtcatatatttgcataggttacaaggattcatttatttaacaaatattattgagcatctactctttgccagcaactcttcttggtgcttgtaatgtatcagtgaacaaaacaaagatccctgccttcatgaagcacatgctttgggagtggcacaaatgtggacaataaacaataatattaatgaattagtaagtgatattaaatgtcagaacgtgattagtgctaagtaaacaagtaaaaattaaaatctggttgaagagatcagaatgtttgatggagtggtggattgagatttaagttagttgatcatacggaaggccttattaatatgataatactttaagcctatgaccagtgtagtaagcctagttcagagtccacaacctaggcttataggagatgctacatttccttatattctacaaatatattttatttagattttggtgccccattcgaacgaagtggcaagaaatccaaattatttattttagaacttatgaccccctctcccatcaccagtgattaagtttcccaagtcttacctaatgacattagtcttctctccaaacaatttacttttcagtttttcattgatatgtttacctctctcatacatccgtgtaagatatgccgtgattccccatgaagttggaaactggtggctaaatcccttctacttacgcacatcaggaagcagtcctttggtgagatagtattatctctctagaggtcttccaggaaacaggctctctgctactcagattcctacaggcctatttcttttttcattatttggaagatttttctgaactggagcatcccctcctgcctccaaccacttcttcaagacacacagcttctacccccaaaatccattttttaaaatagactttgagagttcattaaatccttaatttaaatctatggcaactaaaaaactatatccctttcatcattgtcatgggtgtctgtatcttcaaacccttacaagagcttggggaaattatttatcttctattctgcaagtataccaaagaatagaacataatagttgttttcatactaagtatattttcatagtaaaagagtgaaaattcaaattccatcacaatattgaggaggtatcattaaacctgattttgaaactggatagaacagtgagagagaaggaggaataatggtgaccctcaggcttttgacttgaagaaaatagtatctctgtatgctactcatgaagataagtaaacattagctagaccaggtttgtgtctttgaagatgagtcatttagttcagggatttctgtgtttaaactacttgtgggacatccaaatagaaatgatcagtgacatttagaccaatttgtagtttataaaagagatcccaggtgaagagcttgcatcagagaagaaatcatttttccgtttctgttctccctaccattgctccagattctgtttccttcaatttctgctcaaaacttatcctttctattattttatattattgtatctccttccaaccttcaatcattatttcaatcttcaattgtggcataatgcctctgactatgagccgttattaaaaagaaaacaaaataagggaaggaaggagagtaggaagaaaggaaggaggcaggaagagaggaacggcaggagagaggaaaggaagctcttcactaacgtttgacaatttgcgccagcagcactctgtttagtcttgtgccttcagggatgacttttaatatatgattcctcaatatttttccagccttaattttaatcttctgattgtcagtagtgggtcttcaaataataagcatctgtctggctgccatgccaccaccaccaactcaacataatcttaagctgaactggtcatcatgcttgacaaataataaaaacacaaccttgtcttattcttaataataagtattaaatacattccattgctcaggcatggttttattcatgactcccaccagccactttggatcatccatggtccattgctcacttctgcctctgtgcctttacaccattgactttgcccagcctgaaatctatctttttgcaaggtgcagatcaagtttgacatcctctcttacctccattacctagaactaagcacttctgatcaataacatgtctgagagccaatggatttttttcaccatgaacttaacataaactacttttattgatttatctacccttttatactttgggtgttaccttaagaaggacattggaagtttttctatctagtgtgatcttgttgtatgtcttttttacgttcacagtgcctgaaagaaatttttcttccactgaaggcttgatgctatgaaatggagtagctcactgttttttctccaatccatcaaattcctttctctaagtatgaaactcggtaaccactgacattcctattccaaattcaccagctatgtgattttggtcaagttacttgaccacttgaaaccttaatttctgcatctttaaaataaagacaacaccaattcttaccttgtagacttctgagcattaaatgaaaaaaaaatccatgtgaagcatttagcagtgccagtcacagtgtccaacaaatatttagtcataatattcatatggtcatatgtttctaatttaactacagcactctaattatacaacaatggaaaacctagagatgtcttcatttcctcctgctttctcatgtttcttatctgatcaactggtgatcatacaaagtctctaatcagcaccatagcactgctaccaccggaatgaaatctttatgacctctcactagagatactgcaatcattttctgacctaagtgattccccactgatgtcaagcctgcttcctagagcatcattttcaatatcccattctcctaaacaaaatctttaagaagccccagtctcctgctgtagtcaataaaatcaatattgaactcctgaacctaatattcatgactttccacaaaatatccactatccaattctaacaaaccaactagaaaaaggcattttttaggtaagagaggaattttgaatatggactagttattaaataaaaacaaggaattatatttattttgctatgagtaataatggtattgtgttatgttaaaaatgagggtatattttggaaatgtatcctgtataacataaggatgcaatgttataaaaatctgggttttgttttaaaataattcagaaagagaaaaacaaatagatgaatcaagtttggtaaaattttggtaatgagtgcatatgggataagtccattatactgttctttctgcttttgaatatgcttgtttttcacaatacaataagtaataaaatattataaattatataatccattgcatatgctacctgtttcccgtacttctaagagctgtttttccctactctaaatccaaccacattcttttattgctcttttgtcatttattatctgtagatgtgtattataattgttaaatattttagaccatctgttagattataaactttatgaaagctttaatatattacttgtccttgtatcccaaaattttctaatgtattttctggtacacaatagcttacatagtaaataattgtgtaaacaaatgggcaagaccataaaataaattacaaacatctctgaaagaaagggttatttctttgataacaaaactaatgcattttctaatgttgtagcatttctagcctgagacctaattaagcaactgaaaaagaagtggtaaaattaagagccactgtcagcaggagtactcataccataaatttttaattgctgaattttgagacaaataatgacttttaaaaagagtagacagagtttatgaataatgattctcaaaatctacccaaataaaagggtagcaataacacaattgttaaggggacagaaatcccgtagggaaatgttaattgtgttatcatgttttaagcctggagaacataaagacttagaagtaactttaaacatacaaagtttgtttctattggagaaaaaccataacctattatagacatgctcaactgtatggacagattcaaacaattcttttctctccccttataaataacactaagtatttgtaacatcttttggagggcaactgtatatttgtttttcttgcaatagattagcaatacaagttttgttttttttttttaatctctctctggacaaaaaaaaaaaaaaaatagtgcctttactttccttataaaatgtttctctagctggagatataatttgccccaaattggcaacgtgtagtcttacagaaatttctttccctctatcagccagcaagacaggtggccctagctttggtccccattgctctgtgtcactgcacacctggacctaattgttcagtctcaagtggagcaggtgagatgagggtgggctgttgtgcaggaaatgaatggacttaacacagtggtttgcttcggcaccaggcagtcttatttgagtgggtgggcgggcttaggctatgggaggctcgggagggagccacatagaaggacagataatgcaaacacagactttagattccaaaataattcctggcattaaggagggcctggcagcctgcttacatagtagttaaatgctggttaacaccaaggcaggtgctctgcatgggctggacaattgcaagcacttggataaatattagttgttgatttattatcactgttttaagagtgtcggtttcccagccttcaggtagattctactaatttattctatctatccccctgtttaataatttattgagttttaagaacaccgcagaggaagcagccattgttaaaggaaggtttcaggtcacttgacctgggtagatttgtaaacataaataaatgtgtattgcctgtttagctctatttcttaggggcggaagcgtccagataagaatttgtcattcgcgtatgctatttaattattatgacagatcaaagagacatgctggatgtgttttttgtgaaaaaaaatcacataaactcaatgtaagcaggggaattgagacagggaacctcatctttaaacttcaaggaaaaatttgaggctgtaactgtgatgtataaaaaatattaaagctcaggttattcacttagttaacaagtatttactgaaagcttagggtgttccctgcattctttaggatgatgggacataagtgagaataaaatacagtgcctgatcgcaacaagctcacagtctatagaaggggactgacaacacaaacaacatggcagttttaacatggctgcttatctgaagcctgaggtatgcacaggtgctttaggatacctgactgcaaccgctcttcaaagaaaaattatttcttctcttgatgtgaaatagataaagcttcaaagacgggatagaaggctttaagacatgtagatgttctgaagtaaatgactttacacagaatgatttatgcgaagtgcattaattggtactgctagaaagctaatttaaagaaaatcatatggctatattgacacgatgtgaattttagagctctttagattgtaagtgacagaacttcagttcaaaaggattcaaaacaaaggggaaataaaagtctcatggagctaaaaattgtaggagctagaggtactttgggcacgtctgggcccaagtcttcaaatgatggcatctggaatctgttcctctcatcattggcccagttttcttctatgcttccttccttgttagagaggttaccggcacatgacatactcctgcaagtcctggctgacattcagcaagattcaagaacagtgagaatgaatatattttattaccaaatgcttcatcagaaatcccagaaaaacctctaatagcttctgattgggtctggtgtccaaccttggctaatcccaggagccaggacaatgtgagtctctaaataaccaaacctgggtcacattaccatcttttgagaagggaatcaagtcagcccacccaaatcatgttgactgagagcagaagagaggtagttacctgtaggaaattggagagctcttacaaaaagtgagcatggttgctggactttttaattacattttttttaattttaagataattgtagactcatgggtttttactgttaaacatttttcttagatacttaaaaattaaaatctattcactcaaaattactaagctattctctcaaagcctgttttatttttttacatgggatacatatgctgaatgtgcaggtttgttacataggtatacatgtgcattggtggtttgttgcacccatcaactcatcatctaggttttaagccctgcatgcatttgtcctaatgctctccctccactttccccacactccctgacaggccccggtgtgtgatgttcccctccctgtgtccatgtgttctcattgttcaacttcaacttatgagtgaggacatgtggtgtttggttttctgtttctgtgttagtttgctgaggatgatggcttccagcttcatccatgtcctagcaaaggacacaactcattctttttttgtgactgtgtagtattccatggtgtatatgtgtcacattttctttatccagtctatcattgatgggcatttgggttggtcccaagtctttactattgtaaaaagttctgcaataaacacatgtgtgcatgtgtctttagagtagaatgatgtataatcctttgggtatatactcagtaatgggattgctgggtcaaatggtatttctggttctagatccttgaggaatcaccacactgtcttccacaatggttgaactgatttacactcctaccaacagtgtaaaagcattcctatttctccatatcctctccagcatctgttgtttccagactttttaatgatcaccattctaactggcatgagatggtatctcattgtggttttaatttgaatttctctaatgaccagtgatgatgagctttttttcatatgtttgttggccacataaatgacttcttttgagaagtgcctgttcatatccttcacccactttttgatggggttgtgtttttttttgtaaatttgtttaagttccttgtagattccagatattagacctttgtcatatggatagattgcaaaaattttctcccattctgtaggttgcctgtacaatctgatgatcgtttcttttgctgaacagaagttctttagtttaattaaatcccatttgtcaattttggcttttgttgcaattgattttggcattttagtcacgaagtctttgcccatgcctatgtcctgaatggtattgcctaggttttcttctaggtttttatggttttaggttttacatttaagtctttaatccatcttgaggttatttttgtataaggtgtaagaaaggggtccagtttctgttttctgatactaaaaagctatgtgatattaggcaaatcacttgtgttctcatcttcaaatgtaatttttctggttctattttatagggttgttcacaaggttaatacaatgacaatatctttttaaaatggaaattacgactaaaatattgtattgtagcatttctttacaagcatatatttttaaacgtgtttttactcacatttgtataaagttttatttcttttatattatctctacctcttatgtacacagagaaacacttgggtttaacttctaatatgataatttcgcctcttacactttcaagaaaattaagatttggattttccatactccttcattggttcttcattgcttatttgtagattaattagcaagcattatttatattgtcactgacagacagcatgatataagtgatgataactgtcaatcatgcagcttactgggtttttttttttttttgagtgagtggcatgaacatttctcttcactaattagaaatttattctatacaactcttccttagggttgaccagtcctgcctttcactaagagacttctcacaatgaaagggctgcctggggcgcactggaaagcttagtcagcagcggaattaccttcttcctgaaggctgactgaagaagggaatgtggcaatgagcaagaggcttcacaaatgacagctagtcatttgtgctgggcgtagagtcttcttgcctgcattctaagatggtggggatgacaggaagcaggtctgcatcatcagctcagcacactggcatggaaccaggaatggactgggaggcaagacttttgcttaatgtctgagtttccttaaatctttttagaacaaagcaggacaaaaattttaaaataaactagtatatgaccttgaatacattaaacaaaactattctacaatttttctagcttagaacactcttttagcagtcattttaaaaaacaaattaagattaaggaagcagtttatatttcttaaattagtttattaattgttttttcctgagtagtaaagtcttaagcaatgcgtagacaatttggtgagcaggtaacagctataatcataaaccagaattctcacctcctaaggaccactgccagccctccagagtctgacataagtaaaccacacaattaagcaaattcttgatcaccccagtgatatagatagaaaagctccgatagaaaggaaagtctattctgattatgatgggttggtgacatggagaaggattaatgattcagactgtagacaattttggctatatagttaatacatatatacacaaaaatatgtatatttatatattgaaagtgaataatagcttatatatatataaatatagagagtaatatttaaatgacatgtagaaacttaagtcctacaattctatgtgtcactgcaaaatagcaagctaactgttgaagaagaaagtattgacagactccattccatagattataaacctgaaggaaataaatgaggtgccaaggcaagcttctctcccacgtctcttgcataagttgtgggcattgcattttcataacacatctttacaccattttaaatatgaatgtcaattgcaggaaagattaaaggcattgtcctaagagcttaattcacagggcgtgtcctaagtattagcaaaagcgaagtccagtatgggtaagagcaaataaaatgagattgctgtttaataagccatatttgtaattgaacacaagactttcaagtgctagaactaaaactgctttctgagagctatcatatatcagatggtttccctgagcacttgcaaattaaaagatttttaaagatatagtgctattccatttatgtgttttacacagagttagattgatcacattaataatcaataacatttggaaagaaatgatgtttgttaagccagcctcaagttatgatttatttatttttatgtagggactttagttggctgggaaaatgactgctcagttctcgtttgcctgccaaaaagcagacattttagaaacagtgatgtaaaagtcagtaagaattatgtggcttcaagtggcagaatacctacctacaaccggcttgagcatagagagagattattggctcatgatacttgaaagtccagaggctggtatggcttcagacaggtccgcacccagggaatcaaatgaaatcatttggatccatcctctcttccagcttcacattgtacccagatgtgaagaatttagaggcttttctttcctcactcctttcctttcctcactaatggctttagtcatagatacactctcctgtcttgtgccacagtggcctccaggagctccatgtttacatccttacagttctagttcaattgaaaacagagtctgcctttctttaaacagtttccaagctctgatattccaatccactggctctgattgggattcatgtccggtcttgaaccatgtttggtgaccaaaggactacagagtcttaaccaagtctaactacattacgcatttgtgccagaagctaaaggaagtgtcagcatcacctgggcagtagatattggatgcttgagcaagaacattctctagagaaaaattgtggtgcaggcataaggagatgaggggtgtgtgtacagggtttcaagtatagcaagtgtccagtatagatttttgttaccactggtcaatcacagaagaggatagtaaagtgaagggaggttgtcttatggtgacatctaaaagccactaaaatgacattccctggaaatagtttcttgaagaattatgtcttgtagggaatatgtttgtggaagctgaacacacaaataagtggacggcccctctccatgacccaaattcagatacgtctctagcaaaagttctatcacagatactcttactattagtcaatgtcttcctatatcttgctacacctctgattaaaaacaaataaacaaaaaaacttgtctgtatgtagaactatcaatttttagggtgatttcccatttattttttcatctgaaatgttctctaagtgctttctattttattagctaaactaattttactttgtttaaatttcaaaatgatatatagagagtcaaacagaatggcttctaaaatattttagtttgagacttactctgtctgagcagccctaactacatttttctctttaagatacagttttattaaaccctattcacttcatactaaatttaatactagattattatatccaaggaaagaaaaatacttaactctactaaccattctgttttattttctttttgtgagatttgactcttttttccagcatattgaggtattttgaggtcaagtttatcatgaaataaacttccctattcctcaacccatcacattattatgtagattgggttaaagtgaggctgcaatgatttcctcatcctatgcagtagtttcctctacctgaaggtttcttaagcaaaatatctactcattcctagagccagacttgagaggcatgtaccttagagttcttgaagccaggatttatgattcagttctaagctgaagatggcgaatattaattgcgaaaggatacaggaagaaaaccctccagattcttcacatctgggtacaatgtaacataaaaggaggagcaaaggtattaaatttgggtaagaaggaaagaatgttaaggacagtctaaagattgtgttttacctgtgtatatacacttttagccaaattgccagaaataacaaaaggagtgataaatttcctgtttaatcctgactactgcaaattgactgcacccctactattcctcagaaaccaatttctctgggttcactaatgacctaaaactgccaaatacaagaacatattcctgtccttatgttagttgttatttctgttttattttgtaatcttgactcctaattctatgtaattccactccctgatggctttgatgacaacattcatcttaatgacttttctcctatttctgtggtcctgtttctagtctctcatcatccaagtcagaaactgagagtcagactaaagtcatccttcatacatgttccttctccaacacattcactttgatttttaacagcttacgttaagagaacttgcatactgtaaagctcactcatctaaagtgtatgatgcagtaatttttagtgtagtcacagattcatgtaactatcaccacaattaattttaatacactttatcacccccaacaggaagctccatattcattagcagtcactttccatttccccccaactttccatccctgcatccccagccctaggaaaccactaatccactttctgtctttatcaatttgcctattctaaatgttccatatgaatggaattatatatgatgtggtcttttgtgactggcttttttcccttagcataataaactttgaggttcaaccataatataggacgtatcagtatttcattcattttatcaaatagtatttcattatatagctatatcaaattttatctatccattcatcagttgatggttacttaggttgttttcacttttgggggattatcaataatcctactagtagcattcatgtataagtttttgtatgaatgtatgtttttatttctcttgggtatatacctaggagtagaattgctggatatcttttataagggtgctaatcccatttgtgagggcttcgcccttatgacctaaccatctaccaaaggccctgcctcctaataccatcacctttgagattaagatttcaaaatgtgaattttgaggagacacaaatattcagtctatggcacatagtcatatgtattagttcattttcacgttgccaaaaagaaatatctaagactaggtaatctatttttctttaaagaaaaaagaggtttaattggctcacagttctataggctgtacaggaagcatggcagcaactgcttctggggaggccatggggaacttacaatcacggcagaaggcaaagccagagctagcatcttcacaacatggccagggtatgaggaagagagatgggggaggtgccacatacttttaaacaaccagaccttgtgataactctgtcacgaggacagcaccaaagggatagtgataaaccagtagaaactgaccccctaatccaatcacctcccaccaggacccacctccaacattggggattacaactggacaccagatttgggcaggaacacagatccaaactgtatcagcatacctactcttctttccagtttgtgacctctgtcatagtttaggacctcattagttttctttttctttttctttttttttttttgagacagagtctcactatgtcgcctagtctggagtgcaatggtgtgatctcagctcactgcaacctccgcctcccaagttcaagctattctcctgcctcagcctgctgagtagctggtattataggcatgcaccaccatgcctggctaatttttgtatttttagtacagacgggttttaccatgtttgccaggctggtcttggactcctgacctcagatgatccacccgcctcagcctcccaaagtgctgggattacaggtgtgagccactgtgcctagcctaggacctcattagttttcactgggattggggaataaatatttatagacatagtgtgtgtgtgtgttttagtatatatgtatgtaagtgtatgtgggtgtttgtgtgtagtctcttctgtatatacccatatatatattgctgtttgtgtggtggtaaacttcccttttcaaggaagggattactttataaagagtcaaaagtttaaaatgaaaataatctgaaaagcaattcctcactttctcacaaactctgagactgagtccttagaaatcagttttttgctttgttctttaagaagtaaatgataggaagagggctgagtaattgaaatgagggaagtgatcttattaaatagattttgaatcccaattatacttaaattgtgtttctgtagccaaaaatgtaataaacacgaataaatcttctttatcatcatttataataccatctgtacagataatctaataacctctatggaatgtctgctctgttctaggcactctacatttctttaacttaatttcacaaccttacaaggtagttaaagatgagtatcacagaggcattaactgatactagaaaggttaagtgaagtgcccaaggtcacagagctagtttggatctgtgttcccacccaaatcttgtgccatattttaacgaggatttcacccaaggattctcttgctctaaacccacattctttcttaggccaagtacacatcaaagcattattctattatttaagtgtcagaataatgaaaaaaaaacaaaccagcatttcttagagaagaaaggtaatgtgggctgaggctgtcaaggacaggatcagaaagaggtgacttttaagccagcccttaggaggagatggagagagggtagagatgttttgccataaagaatagcatggctatcattgataggagctgaattatgagaacacatggacacagtgtggggaacaacacacactggagcctgctggaagtgggtaggatgaggggaaggagagcatcagggaaaatagctaatggatggtgaacttaatacctaggttatgggatgatctgtgcagcaaagcatcatgacacacatttacctatgcaacaaacctgtacatcttgcacatgtaccctgagattaaaattaaagttgaagaaaaaaaaacgaatagtatggcataaggaaataaatagtctcatagagcattcagtctgggcctcataagagattgctttttttttgcttcatctctttgggacaaatgttcctgcctgatttaatagaaatggtatattctctgcagatacctttgagccatactctgagatgcagagatattttatgttggaaccagctctgtcagcatgcttgaataggcagaatttttcctctaagctatctgaaatggagctgagttaccaataagcaaatcataacacacaagaatggaaaagacgaacatttattccatccaactagtgcttacattaatctgattaattaaagcatgaatgaaaactatttacttgtgagtgttgtgaaagagcagcattaaattagcccttcaccctagcagacacactgtgattgttggctctcattctgtttttagcctcattgctttcttgtatttcctactagtggaagctgggccagtgcatagccagtgaaggctttctcttatttcactggtgaccagactcaaaaaaagcaaggtttttatattgaaattcgtcaagaaacttgccatcagacgagtacatatgcatgaccacaaggtcactacccaaatggaggcaagaaaatgagagttatcttttgcctttttgaagatttttccagaggggtttagttgccagttgggttttatctaatttagtttcctctaaatatttttataaacagcaagtttatttccagttttctattgtttgcattaactagggggtttaataatttctcacatttatcagtggaaataaactatttttattgaatatattctagcaaaagatgctttgaagttttttttggaaatatttaagaacctaaagaatgtgaccaaaaattcctcataaaatagccttttgctcagggtcttatgttggcttggattctggctttgaccttgcaatctctgtctatagtgaccacattaaatgttacttggacttaataagatcttctgccttcaaagatgaagcaaaaagtgttgatagtttttaaaataaagaaatgaaagcaatagggtgcgagaagtgtcttaaaattgaaataaactcaaaataaaattgaatttgtaagtaactggttatgacatggagtgccataaaactgaaaatatttgactgtagagatttcttggtaaagaagagaaatatttggagtcataattttaaatataatgtcaagttctgtttaaataaacaaagtttatttaaaatttagacaagatagaaggccagagaaagaaagggtagctttatttagtaagtcaaaatatatgttatagcatttatcaaattcataagatatttgaccaagtgataaatatgaagcttatgttctgaaagggtagacaaaaaatgcaaccagctttgtggtagacagttgtttaagtatattgataatatcctttttaaaatttgtccacctgaagcctctcttgatcacctccttgcctccaaccttggaaattttgttagctctgcccctaatacttggctctctctattacatctttaatacttggctgtattaggaagtatattccactcagtggtaatcttggttttgtctccttcttatctattagaaggtgagcaacttgaagcagaggcttcgctttgtctttgtgtctctagcaccttgccaaaggcctgctaataaataattatcatattgaatgggtctacacaatgttctcagtatgctcagacatctgtgatcacctttacttacagagacagggcagatttgaaatatttgcccctatctttgaagctaatacctggaggtgcaaactaggtggagcagagcccaggagctatttctaggaagaaagcatttctctgatcctttgcttctgcccacagtgttaataacattttgttctgcacccacactctcaatttcattccagctgggactcttctgattagcatcctgctctttgccttcccagagacagaataaaaggagaaggagccacaataacagaattagacaaattgtaacggtgtcttatgtcaatgtcaaagggagaaaatataaacaagttcaaaacttgtcttgggataggttttttttttttttttttttttttgaggtggagtttcgctcttgttgcccaggctggagtgcagtggcatgacctcggctcactgcaacctccgcctcccatgttcaagcgattcttctacttcagcctcccgagtagctgggattacaggcacccgccaccatgcccggctaatttttgcattttcagtggaggctgggtttcaccatgttggttaggctgggtttcaccaggttgggtttcaccaagttggtttcaccatgttggttgagataagtctcgaactccttacctcaggtgatcctcctgcctcggcctccaaagtgctgggattataggcatgagccaccgtgcctggcctcaggagagttattaagcatagcctgccaataacttcaaaataactttgtattagtttgtgatttcagaaacaccttcacaaaccttttttttttaaatttgattgatccttatagcaacattgtcagtttgggtgggcgagggagttataatgctgtatccacacgaaggaatctgctttagttggttggtaaagtcttcacaggacctggaatttacaagattggtagcttgatatacagaagatattggaaagggaaaaatgttaccaatagagataacaatgtgagaatgaaacagaggcataaaaatgtatgttataattcagaatactcagtagtacagaaactaagggtacatggtggagaggggatggaacctacaaaggtaaagcagccaggaatcacatcagaaaggatcttgcttgccatgctaaggggcttggacttcatccttggacagtagtgagtcactgaatgctgtttaacagaagacagctgtgactatttctgtgcttcataaaaattattcagaagcattgttgctcatgattagaacagaagcatgccctttttttctgcttcaaaatatattctattcacacttgaaattcaattgcatgatcctacccaaggtgaagggcaattaccaacctgttcattgtaaatctcactcttctccaaagaaagagtctccagatgaaagtgagggggacctttgctattacagggataatctcagatacatttaaattttattaaaaatcatttgcaactattagcccattatcattattagtaaattaaatatgatattctttatgtttaaaacactgtgtctgatcagaaagaaatgacagtggaagaaggaaggcagaagaacaatcagagcactaggtggagaaccaggagagagacctgacttattggggcatggcagagaacctgagctttgttcctgtaaccacaactgctactgaatttatcccaacagcaaaactcccactcttatattttaagccttctctgctggtaccctgttctaaacttacaaggctggatgactcctaacaagtgttaaaaatacttgactgtagcctagggacatattttttttaatgtgtgggtaaagagttttccttcttcaacaagttcaattgaagaaagcttcttatgcctatttcaaaacacacgcacaaatttaggagcagtgagatgaattctcttgcagctattttgatttgagttgtttcccccttggaatttgtggatagaaactgttatattaggctccacatcattagttatatttcaacttgaactttaaaagtagggctggagacctgaggtaatgattacccccaagaatccttttatccttttaagggcagatgaggtagatgagtccctacttttgtaactagaagaacttgataggctaatgtttctgatgatatcttctgttaaaaaaaaaaactaaccctgagatactctttagaaagagttctgttgtccaatacttattttaaattattcttataaaaagctctctattaaagaatcataatacacatcagtgatttaaatatcttaagaaatccttcagtaacaaaattaatctgtttaacattttattgcttgccctctacttcctatcttcctataatgggtcagaatgtggacatgaatgtcagccaacctcaaatatgaggccgaggaaaatgccctaagagcgaacacaatagcaaaatgggtccctgtccacctcgcaaagcatagcctgcctttcaccctagacttttatggggagatcattgtttgtcctgttttagtgagggtttttaagtttcatttgttgtaatatctcagcttatacactcttatactcaacatacttaaactattttgaccacagaaattgtcttaacggttttattggaaaatctgctatcaataacatcttgaagactacatttctaaaaaagatattttaggcaacactgggcataccaaaggattctttaattctgatttcttgattaacaatccttgctctgtgcatggcttgttccatgattttcctattctctatttcctggttggcacttctttaattgctgacacaggacccatatttcacctatctgatggctcctgagaaccctccactgggtcctctggacctggccaggatacaggggataaaagagtatgtcgaagattacttgagaagtctggggcaccattatgcagcaggtgaacatcactcttgcttaatactgtattggttgtaagtcagtcatatggtcctattaactgccagggaactgggagatgtagtttagttgcttgttagggaggaaggtgaaatcattcgatgaacacagagagttgtctctgctctccttgaaaaatatcagagattcccatctttaattcaactctttctagttgttttctcttttggaaatacattaatgcttcttcaaggagccaggcaaagcaatcagatcactcactgtaatccttatgaggaagtgtatatccttttcatggtcaaggttgttttgtttagtggaaagaaagttggttgaagaataatgtggtcagatttctagttctctctcttgaagttatagcttttttttttttttttttttggtgagacggagtctcgctctgtcaccaaggctggagtgcagtggtgcgatctcggctcactacaagctctgcctcccaagtagctgtgaccacaggcacccaccaccatgcccggctaatttgtttgtattttttttagtagagacggggtttcaccgtgttgccaggatggtctcgatctcctgacctcatgatcctcccgcctcggcctcccaaagtgctgggattataggtgtgagccaacgtgcccggcccctacattatagctttcttaagtctctattttagtcagggttctccagagaaacagaaccaataagatagatagatagatagatagatagatagatagatagatagatagatagatgatggatggatggatagatagatagatagatagatagatagatagatagacagacagactatatgggatttgttagagaaattggcttaaggagttatggaggttaagaagacccaggatggaccatctgcaagctggagaaccagggaagctggtagcgtggatcaacccaagtctgaaggtctcagaatctgggaaaccaatggtgtaattctcagcctgaagtcaaagtcctgagaactaagggggccactggtgcaagtctaggagtccgaaggccatagaacctggagttctgatacacaaggacaggagaagagggatgaccctcttctttttgttctctctgagtctcagccaattgaatggtgctcaccaacactaggtgagggtggatcttgcttccttattcaatccagcaagtccaatgctaatctcttccacaagtgacctcacagacacgcaaagaattaatactttgccggctatctgagtactccttaatccagtcaagtggacacctaaaatcaatcatcactgtcacctaccttttctgaggatcaatctcctgatatatagaataagagagaagtttacatattcactctgatcatagtatcttgttatttaagagccaaagtggatgtaagaaccagctgtccctacatcagactctgtatcagaagccatttgacaacacctctgacaggtgttcaaattctagtagaattcagagaaatatctgtctgccaaggcagctctatttattgccatcagttatcattaagtcctttctagtaatgagcaaaaatgtaatggtaaaatcagctagagcttagagatttgagtcctccttcttcacctggtcacatgtgagtcaactggcagtcctcattattcatctttccactaaattttaccatttatctttataatttttcagatattatcctgcattgttcagcaatctcatcttcaagtgtttgtttctctttccatccactcttccaaaaactctgtcccatcatcttggggaacattgaaagtcactgctggatatttgacatctggtgacagctttatcttctgtatgggtgaaatttggatttcaacattgatatcttttattcttgactcaccgttccatctactccacttgtacatgataatgtggcttcaatccctgctataaacatggcttaggatgctgcttctgcatattttgccccttcttgctccatagccacatatgaaaacttgtagcttggaccctagactccttttatccaaaaaaggagatgggttagatttccaaatatgcaggcatttccccacaggtcttctgcatacagaaaagataaagataaaaatggaaacttaaactaacctctggcaattcaatgggactctcttgtgtacatgatcacaagcatctgaaaaatgctagatgaggtattagatctgggagatactggttttatcaagcatatcttgtcatttccaaggttttctagttactgacaatgagtcactgctaatttttccatcctttttgtcacaattactgacctcaagaaggcaaagagtttcatgtgttctttgaatggaattgaagccttgtgcatccaaagattctgttgacttccaccctgcaaactgactttgatgtaccaatgactccagcaggctgggaagatattacttccccaggaaaactctgccccatttctgtttatgcaagtagctgtccttgctgaggtagtaggatcaactaaacaacaaaatcttctttgaggcctgagcactttcctttggggccaccttcttgagttcagcctgcatcactcactaaccttggttggtcacaggaacagttatgacagtacatctgcacagatgttgaaggcatgactagcttaagggccttctatgtcccttcctttaccactaaccttaggatagagtttatttctgatagttccagcctggtggtggtattctactcctttgcagaacacatttaagctactactctgatttcaattctcctctctacttcagcatctcagtgatgaactacattcttaaaacaatgttagtccacccagaggattctgtattgctagtcaatttttagaacaaggagatactcactggagtcaaacccaagggaagaacaattaggctatatatatatatgggtatgtgtgtatatatattgtgtatatatatatatgtatttgatagatttatgtttatttttacatacatgttaagtacaaatttggaagcataagatgacttctctgcaattattttgctatgtgttgctttccctttggaatctgtggatagaaactattatattaggttccacatcactagttatatttcaactaaaatttcataactggagctgggtatatatgcgtctctacttgatatagctgcatcatccaatgatgggtatatatgcatcatccagtgatgctgggtgctggaagatcgccatttagtacccaggtggcaattaattttgtggtattgtatttctgggtgttccctccattcctgacattctttatcatctatgattcaattatttgcctggctcaagaaagcacctttatttcccagtgaaccacgatgtgatagaggtgactttaagtaactggtttattgtgatcaacatgggtcaaaggaataggtgtgcagtgccactccagaaacttaccagagagtacttttgtcttctagaaagtgaacctggaggctcagtttctccagaattcatcttcctctgcccactccaccaacagaacagttggcatcctttagaccaggggtcccaatcccaggctgcagactaatatggtctatggcttaggctccatcattctagggtttgatttttagtttacttttcttgtctgccatactggaatttgctaatatagctgtggtccctgtaccttattatggtgtaacaaatgcaataaggataggggcttcttctgataattaagacttccatctgccctccgtaggttcaactttaatgcttcctacagatgggcaacagggctatctgctcagtgcaacccccagaattccaattgtctgtgctgtctccactccataccataactaagcctaggaagcgcctcctgaagttcttcactgggctgaattaagaacaggatcatcgttctctatctgggtgttttctaccccactgagagaggtgaaattgtcagaacaaaaatttaggaatttaccaaatgcagtttttttttggctgataattactattattaacaataatgacaatgataagcttagaaaaattaaacactaaacaatggctgccgtaagaacactgaaatgactttatagtttacaatcagtctttcgtctttcagggatatttttgtggacatctggtgccacattttagtatggggttcagagaatatcaatttacctgtttcttcatcatgctatattgagttatttactccacaataaaggtagacctactgatgagaaatgtcagggcaacctttgtgtatttcagttaccctcagcaaggtgctaccagctagcattagtgtatttctggtgttggtaacaggatcatgtgagccttgtagatgagaactccttgttgctcaggggatcatggaatgctgctctctttcagacagccatcttcggggaagagaagggtctctggcagagctctatgggtcctgcacttctctttcacctctctgccttgttctttcactcattaatttcttgacaatttattttccttaataactctagttccttctgtttatcttcttctgtcaatccttgcatccattgcaaatccatcacctgctctgaaataccacactgaagggaggtactcctaaagaccttccttcttttccactcttgttttacccttggcttacacaactgttgaacaactggagctgaggacaaaaagcacataaattccaaaggtcaacggaatcacttcttcatagtttacatctcctgtgtcttaagtagaactcaaatagaacataagcattgagaacagaggtctgagttggaggtcaagacatcgtttactagctgagggactttggctttatttttctcatctctaagagggaaaagataaaaatctacttcacagacctgttgctgggaataatgagataatttatgtacagtacttagcacattgcttggcacataaaaagtgctcaataaatgttatatatttataacattatttgtaacacctcgtctttcaaggaattatgggaattattctgtttgtcagactttgtttatggaaattatgtccttttgatggcccaatttttcttttccttttcttcatcttttgataacatactattaaatgtcaacaattcatactaattggaactagtgtaataagctgtcctcctcatcagtattagcagtctttgaacatggcataaaaatatgcccattttggcttacaggtccttgattctctaatgataatagtgcaggaaaaacattagatatggagttcaactttttaaaactgtcttgatgttggtgaccaataatttaaaagaggttagcatattttaaggtgactaaaactgtacaaatgaaattgccatttaaaaatgtctgttcatttgcttttctccaatgcagatattttaaataagaagaagtgaggcaagaaaaatgtaaacaaatattaggtataaactaggaacttagtcttttattttctgaatcagatggatgatatttaaaagtctgggtgaatgataaatggtagaaaaaaattaaataacagtcaatatgcacaacttaatggaggtaaaataagacttacttacttttatctctataaattaaaatgattttgaaaatcaagctgccaaaataaaggtgtggattttatcattaaagcaatgcccaagagacatgttattgagaaattatgtggcattggtttgttgttactagcgaaatgaatgcctaactgaagttgatttcataaagatttagtgtgtgtatgtacttgtgtgtctgtgtgtatatatgtatatatatatttgtatacacacgcacacatgtctaccatgtgacatgttgctatttttacaacttattttaaaacagctaaaattttctagatgagattaaacattttccataaaaataaaattacaatagttacctcaaagtttgtttatcctggaaaaaaaagtgctaacataagagttgttcaataatattttaccaaaattttgtcagaactccattaaaaacaattcaagaccacagtggtctaatttcaacactggcatcattaacctaacatatttatggaatattcactatatgttctgttttctgcttaagtatatgaattaaacatagtttaaatagtttactcaaagaacatgccatttgcttcattgatttcacactctctgacgtatgtattaataagaacataggaatccacacacagaaataatagcattcctatggtgcattaataaaaatgtatgaattttctatgtctaggacatgtattcattatttgggtgggtcttatatttcaggtactgttctgtgaaccacgtttatggaagtgatcaaaacaggcaaacatctctgccttcatggaatttacatttttcttggaggaggcagacaatagacaaaatatttagtatgtcagctaaatactaaagggaaaaaccagaggaggggatagtgtgtggtattgagggtcaaggccagtctcagtaagaaggcagctgtgagctgtgacaagaatgagggaagtgagccatacggagcccatgtaagagatttccaggcaaagagattaaaaggtggacgcctcctaaggaatggacatacctgccatgtttgagtaatgagaaagaagataaaatggctaaagtagagtgagtgagggcaagaataacatcagagaagtaaaggagtctagattgtgagcattgtgaacactggggaaggcatagactattcacaaggagatgggtagctactaaaaagttttgagaagaagagtatgtgatatgatttagggttgaaaaggattgctccagtttctgtgtcatataaccctatggtcttgaaactgggatattgtatccctgggggcatgaggtggcgtgcctagaggtacacaaaatcccaggatcagttagtcacatcttccctaaggataaaatttaccctcaagactatggggaaaaatgattactgtgttaagaaaaacatttaaattttatataaattattgtaaaattcccgtgattttaaaaataaagtatcaataatatttcatatttgtggcatcttaggctttaatcttacaggtttaagcttcttggccatcaggagtaatttgttgaaattgcaaattaatttggcaaaattatcataattatgtgccctgagagcttatgtatcttatgatagtgcaggaaacttgtgagatgaaatagttgagtgtatacattaaaataatttgatctaccaagtcactttaattatttatttgttcagtgttaaaaatatattttcataaccaaactaatacatcttaataatgttgtagaaatggaagtaaggtaaaatttaagaaactgggtttgttcttctgacttgcttattaatactggataagttactgaagagtgggctttggtttcctcgtctatttaatagtgtgggaacaaccttatgttaaagcaatctattcagtataactttagcacacagaaaataaaatattatgaatccaaagaaagtgtagcttgcaatcatgtattttattaaatgtatttatcagcattttggcttctgatggacatgtgtatatacatattttgtggataaaaaaattacttaactatttttatattagatactatcaattattctggctgatctggggacttttaatggtaaattttatatcaaatctgacaaagacagtatttcagacccgtttaagacctagaactcaccatgagttctaaaattggttctcagcaccatggacagcgttactgcaataggaaattaaagatcgatttggccccaaattaaaatggtgttgtaaaaaagtgggagaaaaaaaatgcctatccttttacttcaaattttaaaaaaatgatcctggccttcacaactgttcataagaagaataattaattaaacaaacatatattgagaacatcatatgctcagtaaaactttgattctataaatggtgtcatttaccaaatggattcttttgacaatttaattttctcttatctctctaagaagatgtaactacacactatagtatactactacaattatcaaatttcatgttgcatgtaacttgtcgtctgtatttttgtagttagattagattaactaaagatttttcaagtttgcctttaagtcatttaattttcctgccttatctttaacctttcaacattcctccaaacaatagcaacacaagtgttatgtgttaacttctctagtgacaaaaacttatacttctccacaaagagatgtgatgttcattatcaataagcttgacatctaaaattgttttataggagatacatattactttttcagatggtatataaagttaaataaatcttaagttttcaatgatgggaaaagcttccatttagtttaaacataatgtaaagaaatttgaatccccaaaatagaattataattctaaaaattcatactataattcttcttaaatgtttaaattacagttaattaaagtagttgatttcaaatagagtggaattatgggctgtacatcatttaattttatgtgctgactgctacatagccaaaggaacgtgaattaagatggttccacttttgaccaggagatggagctgtcatgtaagatgctgcctttatttatttatttttctaatttagcatgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcaggtaagccagcatgattctatttttgacttatccacggattgttatctatgttaagaatgacatttaatataagatgtgtgctttgttagcttgtattcagatctaagagattcaaaagctctaattctagctgttgtgcaatttaaaatcttcctaggctgaaatgagctctgactatgacataccgtgttttattatttctttggctttctagctgttggtctctgtctctggctgtatttgtttaccttttaaaggtaaagctttcaaagtgaaggatgggttttcctttcacaagggaaatactgctccttaatgcagtgaacaaattgtagagatataatgaagcagattaacatggcagtggctctgccaaagctcagggctgagccttctgattgcagcctcagaggcaagccaatattctgagtccaaaggccttttgaacgatttctgctggctatgatggtacagattgtttatgtctttatttttacctcttagaaataatacgtaagtcatttctcccacatgaatcaagatttatgtaatgtgtttaatagacttggaatgagactatagaccctccctcctcccccagtatggatgtgaggagtatgctgaacacaaattaattgccatgaaaattgattttttctgtattttattggatttgggataatagaaccgtggccattttaaatagttgatattatagaaggtgctcacattttaaattattttaggtcatgtgacattatctgtgttaaagagtggaatgactcaggaggtggaagttgcatgcaacagccttgcttctctctgctgcttctcgtgatttcccttaaatccttgcttgattattattagaataacaggaataaagacatatagaaatcctatatttaaaaaccactgattttcatttagagaaatttaaagagattttacaaatattttaaaaatagttttgtaagattgtttttaaatgcctcacttctttctcctgtggaaagagctgtgtgtgtgtgtgtgtgtgtgtgtgtgtgtgtgtgatggtggaggtggcaggcggtggaggtgcatcaggatgtttttatctcagtcattgttttcctgtaaagaggtagttttgccatgtcagaggttgtgaaagctatggggaatgattttataaaatggtttggacaaaccatgaaaaaaacatgttttttaaatgtgtggaatctatagagtttgtagttctacatggctccatatacatggagatttttagaattacagatatttaaccatttatccccattatcatttaaagaaaagcaattgtaattgagagataaggtggatttcccagagtcacgtactaaattacaataaggcaaggctagaacagtgattgacagttccacatcttccatagcagtaacacaattcacctctagtgtgaacatatcaggatggcatagaccaggtatgatgatattcactgtgcgtgtgtgtgtgtgtgtgtgtgtgcatgtgtgtgtgtgtttggttatattctgtaaaatagagtttctttcagtatactgttgctcaatggcatattatatgcagtgctcaattttcttaggtttcttgtcaaagcatccaagaaaactgaatgacaactatggaaactctgtttcttagtatgcctttttcattattaggtggtgtatactcttctaccctatgctcatgaatgatgtggatggccacatggctttccctcctacctaatagaaaagattgtacatataggttaatctattgacaactataagaatatcatctcatgtccaagcctttcctcctttgttcacttactaggcacaggctttaccctacttcttcaatatcttgagaaaagaaagggattaaaatgtgtcatgtctacatatatttgtggaataccacgtaccaaccaagtgtccatggtagagataaagaaataattagtcaaggagtttacctcagggaggttaacatgcaaatatacatgtgcagataccactatatctcaaaataaggaatgaagaaagatgagaaagtgaatgggacaggaatatcagcacctatcttgtgccaggcaccatgttacatcctgggattcagaacaaaacaataatgttaatttctgtccatggggggctcagaggaaaagattttaggaggatgtgacagttaaattagatctttaagagtgagttggatataaataaagaaaaacagaaagttgcttattccaggtacataggtgaggcaagtaaatacaagaaaatggagaactataggcatcgtatagggaaactgtagagaaaggtaaataacccaatctgtttgaagcttttgttgtcggtgttgttgttgcagttgttattttttttcccctggggcagtaaaagtaaggataatgaatttggcttttggtgttatgcatttgacatactgacacatactcatacactggggtgttttataaggagctgaacatgttatatccatgtatcagattagtggttaaggctgaatgtatagatctgcatgcagttgtgggacaaaattaggtcatacataattaaacattaatggggaacaaaagagaagtgaagatgactgggggcataatcttaagattaggagagtaaaaaagtgtagaaaactattattaaattgtgtgaaaataatgtgagaagttgacggaataacaatatcataggaggccaagcaggtaaattgaatatcaaaatagggatcagaaacaatagaaaacccataaaggggttggttcataagaggatagagtaaagatgatggatttagttatcattattaggtcataaattaattttaagagaagaggtttagttgaatggcagagacaggggctctgaggactaaattggacatgagaaatctggggagtatatttaagttttaagaagtttgccagggaaaggtaggagagataacattttatacctggagaaagaaggtactgttgagggaaatttaactttagtgcagattagaaaaacctaagccctttgtagagtaaggtatgaagtcagtagagagaaaattgaggaaagaagaaacaaaagtacaccaaggtcgtggaagagacagaaggaaggtttgaaaatgcttttccttgacacaggaagaaagggtggttgatgataatgagcaaagctggtgtaactcactttgggtggcctgtttttcgaaattaaatccttgtttgtaagatgaagtatctcctctgattaaatcagtttgttcctcagtaaaggctattggtggcatatggactttctggaagaaataattaatcctcagtagcaaaacactttcctgcagaatatattttagtcacattaattcttgaattggagactaataacactgtttcacatgaagcttttacatacttcagttatcaatttcttattcataaccacctatttaaaaacaggttctatttaaaacttgtattgaattaggccaacacatatctattatacatatctagtttgattactaagggctggtttgccagtatctaaattaattattcaagttctttccttttttgaatccttcagtttcattagcacgttcaccaggacttgtgtagagagagtcaatgtcatggccgggtgcagtgacttatgcctttactcccagcactttgggaggccgaggtgggcggattgcctgaggtctggagtttgagaccagcctggacaacatgctgaaaccctgtctctactaaaaataaaaaattagctgggtgtggtggcaggcacctgtagtcccagctactcgggaggctgaggcaggagaatcgcttgaacctgggaggcggaggttgcagtgagctgagattgcgccactgcactccagtgtgggtgacaaagtgagactctgttaaaaaaaaaaaaaaaaagtcaatgtcaggaagctcctttcccttagggaactagcttccttatgaagcttcctaccagaagttccttttttctccatttcttctggcagttacagaatcctcttggggctttcttagagccaatctcctctaaggtgaatgcattttcttgcattcacctgtcatgaaatggcagtggaaagacttgaagaaggcacaggcgttggtgagtcatatatatattttgctgataataatgaataccattggcaatataatagtggccattgaaatattatttctattaggaaaagataacttgcatcaagaatatgagatgaaattctattaaaaaatgaaaagtagatgggccaccgtggctcttgcttataatccacttcgggaggtcgaggtaggcagatcacctgaggtcaggagttctagacaagcctggccaatatggtgaaaacctgtctctagtaaaaatacaaaaattggccaggtgtggtggctgacgcctgtaatcccagctactccagaggccggggcaggagaatcacttaaacccaggaggcggaggttgcagtggactgagatcgtgccactgcactccagcttgggcgatagagggaaactctgagtcaaaaataaataaataaataaatagaaaaggaaaggaaagaagaaaaataaaagctgacctctctataacactcatacgttagtgttatctcctctttatccatttgggtttagtgaaattggaggtcagtggaaggagaggtagaagtggattttgcaaatcagaagtataatttttttttctggtaatgttccattaaacttttcagtcaaaacctttatgtggaagaagacataattactaactacattaataataataatgaaaaaatcttatcatgtaatatcgttttgtttattagtgaaacattttagagaaatgatttaagaatcaaaggtatttaagtatattttatttattggaatgtgataaaatatttttgagggtaaaaaactataatttcagttaactgtttgtacttactaaaataacatttagggggataaaatgatcttaggaagaaattgcccacaaaaagtgttttgaattgtttagattatttttatagttttaagttgttaagtcttttgctggtatctaggattagttgggagtataatatgctttgaacatgaacatgtcttggtgttattagcaaataggtatacaattatgtgattgtgtaattactcagctacatcttgtgttgtgtgatatgtatggggaaatgacaacaaaataacaacagttctcttaagcatatatgaaggtagtgcttgaaatatcatgaaaaaaagaaagggagattatgataatgttatgataagagaagactgacactatccctcttctctgaataactgatatcaaaatgtgaaattctaaggaatgaagcaagctggtcagggcaatggtgatgctgtctctgtatcagcccagcatttccagctaggatattttccttcttttctgtgtgatacagtttggctctgtatcctcacccaaatctcaccttgaattgtagttcccataatctccacgtgttgtgggagggaccctgtgggagataatttaatcacgggggtggttaccctcctgctgttcttgtgatagtgagtgagttctcactcgatctgatggttttataggggtttttctccctttgcttgacacttctctgtcctgacaccttgagaagaaggatgtgtttgcttacccttccgccatgattgtaaatttcctgaggccttcccagccatgcagcactgtgagtcaattaaacctctttcctttataaattacccattcttgggtatttcttcacagcagcatgagaactgactaacacactatgtctcccctggattgagcaaatgagggagcccagcaattgtcaggcagctaggatctgtgaggagtgcttagacctacacttactatttcctgaattaacagtctagaagacaggagcctagttatacagacagggtgaccataaaatgtgtcatctaaaccaggattcagtttgttaataatttctccacaacgacaggtataaatcaagatggttccaggtaaactgggatgcacagtcactccacttctaagggtcaagaaacttctacatttaatcagtctattcaattaaattgttcatgattttgttgcctaagtgttagaaagttaaaatgtgaaatgacctatcaattagacaaagggcattcagctaagctgctccaattactggccttgataaatccatcaaccgaaatctctaatgattcttgttgaatccttagttatatcaccaggaatgatgtcactccaataatgttaagcctgacttcccagggaattcaactgtgtgcaaaaaaaaactgttagtaaattatgctgttattacaaacctagactcacagcatcataaatctattcaaatataaaagcaaaagcaggataaaatatggattcaaattatttccacatttgggtatgcatcttttaaggagttttcatgaatgtgtaatccttagaagataggaatttagctccaagaacactggaattttctccactggcactttatacccaaatcttggtaatgtcaatatgcatatgtatggcctcttaacagactatcctgtaaagtagttaaattattttcctccaatgatcatgttttttttacccttcttcagacatccactcccatggttttatcttgaaactcttcatggccagtaactgtggcctgcccataatccttccttcatacatcctacaccacctttctagcgcatttcatctacaactccaattcattcctttaatcccaccaggcctctaaatcactgatctcgtcatactttgattatctctcactaaatgtcctctttcctttcattagataaattccacagttattcataaaagtcactccttgtatatacatacatacctcacaaactcctccgctcagtgtttttttgtttggttggttttttggtaactgtctggctaaatcttcatcctcatattcagttcccaccttacttcctgcctgcacttttgcagctggacgcatgcaaaagtgggtccttcatgatgcccagcaatcatgccacatgtccctagattgatgcccagcaaccatgccacatgtccctggatcacttactctcccaggttcttgtacttagatttcataccctttcttttctcctcaaaccaccaatacctcctaccttgacctcactctcagttgacaactttgtttcctaaatcagtgagaaaattgaaacaatcaggagagatttttccccacaggtttctatcactgcatgtgccttcctaccaggttctgcacccacataacctgacctcccacccattaccttaaatcaactatccctgtttctatctaaaatcattcctgcatctgtgcactagatcctattctttcttacttacacaagggcatctctagagcattttatttctctgtctctcctgcattagtaattttagctctttattatatttgcatacaagcattttattattgctcttgtatttgaatttttttacttccttcaactatcttttttttattttttgttgtctttgcaataatacttaatgaaagtgtttgctgtattctctgtatctatgactctctttctattctcttttaaatttacgttagtcaagtttttactcttaccatttcaccaaatcagctcctgatagaaatctgatgaccaccctattgccaaattcatcagtccatcctcagctttcatcttacttgaccatccagcaatattggagacagttcattgctgtctcccccttgatacactgccttccgttggatttcaggatagcacacaattttgactcttctcttagcttattgttcactccttcacagtcactttactctttactctgccttcccagacttcattatttgggtgtccctgattctgtccctgattttcttttcttctttatctactttcttttgatcccattgagttttatggcgttaaatgccatataaatcatgatgacatccaaatatttacctccagttttctgccaaactgaacttgtgtgtctaactgcttatttggcttggatatctagaagacactgaaaagttaacatccctaaactaaatttcggatagttcttcccaaccaacctgctccaatcctcgctttccccaccttacttttttcaggagataactctagttttcctcatcctcaggctaacaactctagtatcatccttgattattctttttctcttatatctgacattcagtccatgagaaattcctgttgatttcaacttcagaatatacccaggatctatgtgctgccaccttcacactgctaccctgctcaagccaccatcaagtttctcatggatttctgccttaatttcctaattggactttattcttctacttctccttacaatctattctcaatacggcaagacagaagtaagattacgccacatccctgctcaaaattctgcaagtgatatccagttttctcagggtaaaaggcacctgacaatttccaaaaagtctctatttagcctggtctccatcccattacagtatttctctgaatttgtctccagtttttctttccctcattcactttcactatttcttgaatattgcaggaacacttcaatcctttgggctgtttcctctgcctagaaaccttttgcctcaggcacttgcatgactaacctcctcacctgtttaaaatctgagctcaaatgtcgtttctaaataatacctactcttaactatcccatttaaaaatctcagcccccttcctctaacttcattcttatcgtctcccacattcttctatactttcttttctttgttatcatttgctttgctttgttctttttttccttttctttcctttcttttatttccttcccttctaacacatcacattatagcatactgtatacattgcatttctcttgttggtaatttaagccccaaatgggcagagattatcatctgtttggtgcactgatgtttcacaaatgcttagaacacttcctgatctatagaagagactaaaaatgtttgtagaataaaataatgaatcttagaaacttaaatttattcctttaagcatactaaggggcaccatgctttctctttcactttattgggctgattcacatttacaaatgacccagtgcaatctgcctgatttttcattcagtatttacaccaatagaaataaaatgcatattagtgttataaaatcaaaccttaaatgacagtaaatgtatcattaatagttactgaagaccttttcctgatatatatgacatttaatgtttttctcttgtgacttcattgttctttgtttgcttgttcatcttctagattgtgagctcctcaaagtcaggaacttggtcatcatatctgtctcccaaataccacactcaatgtctggcacataagaagttttacaaatatgctgttttagtcataggatgagcatacacttaaaatttaatactggtcctgcatatgctgtgtcctgagctttcgctatgtaggttgctttaattcttacaaccgtgtggagcaaagcactggtctcattttacagatgtgataaagctagttattttgtccaggacttaatcattgcagtattctcactgtctaatctctagtgaccatatcacaggaagttaattatgctctttttttaaagataaattgaaataatgctaacaatgccagatttcttggaaatgttttgtttttagtttcagttagaagcacgccttagcttagtgaataagggacaatgaatgttatttattttcctgctcaattcagttgggaaaattgacctcatcgttttgtgttttcaatcccttaagtgtaataaaattatttactaccttagtttatataaatcaccaagatctaatggaagccacccagttaactctcctaaagagtcttcaagcatgttttgttctaaatctcagcttaagtattttccattgtttaccacctaatgtctatactacttgatttatagaaagtcttatctaatataaatatgctaactagctatgataaaattgatcactttccacataatcatatactgaaaaaaaattccactgaatatatttctgccctccatagattccaggatttcagtgaatttttcttaataatctctgcttcagaaatgtatataaacttttgtcctaatcaaatctaactcaaacgtcacttcctttataatgttctctctgttttcacatgcagcatatacttccattctactctgcacctatctctacacttgtaatgtgaagtagccagatatatgtggacctgggtcatctgtcatatttaattgtgtactatataaggacagatattgttttgtatggttctatcaagctacccagtatctacatatactgccctccataggaggtaatacatatgctgagctctactcatttaaaacttcaatcaaggtactattggaatttcttagttttacaacataactatgtcctacttcaagtgacctattaaaatagctctcaatagtttgctttaatacaactgcctttaatagcttttaaatttagtgtttgtttgagtagactttatggtgatttgtaaaatgatatggatatagtatatagaaaattttaacagaaatgtaaataataattataatttagggaaacggtgccctcttgctctatttcacacacacacacacacacacacacacacacaggcacacatatacacacaaaaaaaatctctatttccaaatcttgttcacaaggagctctctaactccatgagtaatttttacaaccaataacagattaaccaacaatagtcacacgaacatgtacacacacatatacacagcctaacttccccacatcattattatctatctatcgtcaagaatgcagcttataaaatacaatgacctggctgctataggaaaggataaaatgtaggttgcagtgatcttctgacattgagatggcaaggaatgtgttttttgcaggaatttcaaaacctgaattgtagaatgatttgagatactgccttaactaccaacaaatttgatcccatgttcttcatcatttttctgagattctggtttcccagatttctgaccttaattgactcaaccaaaaaaatctgcttattattaaagaccataaggagtaatcaacagaacaaaatatgatttaatataatattaaatatattttacaactcaaaacattctaaaagatgtgatggtttctgactataattcagtatatactattttagttttagtgacaatgtttctaacaaatacaggaaaacgtttcagaacctagtgtcctttacagcaagtagcaaagatggactcaggaatatgtaagcaaaatctagccaaaccaaaccaaccaaccagacaacaacaacaaagtgtgttgctgagtggctcatagacaaggacaagtatttgtgatgttctaatataataggtggtaagaaccaatggaacatctgtgattcaagtgagagtcgtggtggtagaaaacaaaacaaaagaaacgataatatgtgtagaaataataaaagaaaaaagtcaaagggtgtatttttacaagtacacgttcaaatatagcgtgatgatattttatctcaggaatttcatgcaaagtgctgcgtatgttgatatgttaggtctcttctggcccagtgacgattatcttgtgtggtttaagttctctatgccatgagtgaggtaagggcatttattccccagatccttccctgccagattactgtggttgaatgtaaacaccacaactcctgccaagtggcccctactccctctgattctaattattatttcctctttttgcctcctgctgctgctagccttggggtgcactctgctttgtttcttttccttaaccctaatatacctttgtaaataatccttttttgttttaatctctcaattaaaatctcctcttggggtgtgtcatctgttttctgctaagactttgattaatataatagctaacatttatgaaatatttactataatacaggcactgttggaataattcacatggatccaatttttttatcctcacaacgatcatgtgaattaggtactattatgactaaatttaaaatataaggctactgaagaacatagattttaaataccttcatgatcatatagctaaaaactaagacaaaataaaatccaggagtctgactccagagcagagcttagatgtgaaagtaattaatatgcttttaaagaaaatcttatattgttggtgtctgtataaatcccatagacaagatctaagtacgaaaaaaaaatagaagcaagtcaggaaaacttagttcacaggtaataaaactagacacagatatctaaatttagaaatatcccatgcatatattctgcatatctgaatgcatcaagatattaataagcatcttaatactttggaaaaagtatagaggggactttctgtcaacatttgaagaaaacatttaactagtataaatatatcatacaagttaactgaaaaatctatctgctgtctatcctcatgttcagttatcaagtatatatcatttaaatttaagatgaacaaaacactacttaaatcccaaagactcattaaagtaaaactagtaaatgcattttatttatcaattatttccctgaaaatgcacattctttttaaattaattttttatttaaaaaagagcatcatgccattaaacaaaaaaaggaaaattttatttactgggaaattcttgctgatttttacatgggattgtgacaaaaaaaaggtcagatttttatttttattcacagtaaggagagattttatcttcagggatgattacaaggtggggaaagggcaaggatctcaagagttaggcaaagatttctcttttagagagaggagtaaacaaggctagaatgaactggatggggagaagagggatttaagggtggtatgatctgacagagaatgttccactctgagaccagcctgctaccttgagggactatgtaaggggagggggggtgtggctgcttcatcttgaaagtaagtcaaaattcagggatttggggaaagtagaaaatcttaaccaaaatttggttaataggcattttgttcccattggtcagtggggacgggcagtttagcttatcatttatgaggtaaagaatgggaattttgaagttctgtgttgggtctcatcacaggtgaatgggggacatttgtaagttttgcctgtgctatatggggaagggtcattctttacagtaatttcctagaacatgaaaggataggggggttcttattatttcatctacataaactggaacagaagatgatttcactggtttattaaactcctcaggatcttctacctgcccttcttaacctttacattccaaattcacttctatctcctttctagagctggtaatctttcttccatgaagtttatgaaattcttcatgacatgcatagactttgacagttctgtttctgatgtgcataatacctaccagattgatttgtgataatatcattgagaggccacttatagcctatttatgactcagcaaaccatggtcttttacagcctcttttaagatggtttggagagataaagaataatacttcatgacatgtaaaaattatattaagtttgaagtttaatgtccataaataagttttattgggacacagccatgcttatttttatataaattttccatgactgttttcttcctacaaggtgagaactgtatacttgcaacagagacaatatggcccacaaagccaaaattatttactaaatcatcccttgtagaaactaagttgcagactctggtctatatagtcacattacactacaatgatcaagtatagatgtttgacagtatttaagtttctgaatgaatgaacctatatagagaaatgtataggtataactatattactgatatatcctattaattttattatttttctgttgagtttttagcttttctaggtacataattttgtctgaaaataattaggacaattatgtcatgcctttctttgctaatatttctaagcaatcattcctttacttatttctaactaatgtttacccccagttatattgtcagattttcctggaaaatattaatagtgcaaatttcctgctgtttcctaactttgacataaatatttatagtggctcttcactaaattacatttacatcaatatccttagtgatatattgatgtaaatttgatttgagacagatcaacttcataatgtaaggatatttctctttatgaagagaatttattataatttataaataaatgtgatatctgttagatgacttttaagcatctagatgtagttcatattctgttttggcccattaatgtcatgtatttcattaatatatttttaagtactgcaccattttttcattactattttggatcttattttggggcattatgttattaagtagttgtatgttttatttaagaagtttataactgtattcattaatgatattggctgtagatttcatttttgagggtgttctttcggaaaagtttactatcaaatttatatttgcttcaaaaatatttttgagtaattttcctatttttctatcctttgaatgtgtttacaaaatgtggaaataagttgtttctagataatatcaatatttatttgctagaaaataaaaactcacctgtaaacatgttttattgttattttaaagtggttttgcatatttcttttaactcatttccttattaatttcctgatcaagttttcacttcttacatcattttgacaatttcactttcatagacgtacacattttgtagaaaaattcaaagattttaacatagttaataattttgtttgcatacttttcatctctcaaaagctaagaaaaatgaattcatgtcttctacaattaacagctttgcataataacgtactactattaactttatgattttatgaccagtatatatttattagaacatttacaagtacaaaattaccttacttatccatttaagttatttgtgttgagatatgttttctctctaataacattggaaaacctaaatttttgtttgtatttgttgatatatttttgtccattttttatttttaattttggcaatctgttctatgcttctttcaaataaacatctgttcaacttttgctttgtgatctaatttggtactttgtgttggttaattataaattaaccaattcaaaatttattattttaaatatcagataatatttgatttttcttctcataacttgttttgtggtttctacttttcttatatttttcttgattttcccataggggtatatcaactgcagtttttcccatctttattttttcttcttctattttttctagctttttggaatgcatgtattgccttatttcattccattattttaaaagaaaccatcagcctcataaatgaaactatctattaactacccttacataagataaaaatattgttttttctttcccttccaactattttccagtttaaaaaaatgtacatgatttggtattcacgttaatttaaaaatgttctccataagcgtattattttataaccttactaaccacgattattaaaatatggctctatggtttaactccatatcctaacaattattaaaatatggctctatggtttaactccatatcctaacaattattaaaatatggctctatggtttaaccccatatcctaactaaggatgttaccattattaccatgtattaccatttcttctagcatcttctgtagagctgaagtgtatcttagagtcacctcttcatgaaggagatattgatgatatattttctcagctgctggtagatgaaaatatttctgtaatgccctcatgtaataatgataatttcagttgatacgcaaatatttttcttaaaaatatattttgttcttttatcctcagacatctaatatgcagaagataagatacagccagatttttcttccccgcccaccccccttggaaacaaaccattttcccctaccagaaacttgatggatgtttttctttatcctttgaccttctctagctcaacaggaaatgttttcatttggggctcttttcttttttttttttttttttttggtgatggagtctctcgctctgtcgcccaggctggagtgcagtggcgcagtctcggctcactacaacctccgcctcccgggttcaaacaattctcctgttttagcctcctgagtagctgggactacaggcacctgcccccacggccgactaattatgtatttttagtagagatgggatttcaccttgttggtcaggctgatcgcaaactcctgacctcaggtgatccacccacctcggcctcccaaagtgctgggattacaggggtgagccactgcacctggcctattttctttaatgtaaatactattccataatcctgtttgatttacagactctttttgttaaaagatttcatttgttcttgagattagaattcgttgcaacaactgtggtagccttagtttttccttttcaatttactatctttaatgatagcatcctcagggcttttgcaccatgtatatctttacattcttaataattatttccatctaattaactttttactctgagatattgggaagttatcacagacttccatttaacaaacttaatttctgcattttcaaatatgcttattactgtttatactgaacttatgaatttaactatttttacaggtatccacgctatatccaactggactcccttgctaactgtcagctttcctttcataattaaagtgtcctctttaatcttaatcagagtatatcctaaaattaaaatgttctcttctgcttcttattttgaacaatggtatcttttcatatgtttggcgattttttttcctgcttactcatcattacagaagatactctatgctgtataacatttgtattttagatgattctatcaaatattgcttatttcctgtaaacatctaaaagtcttttaggctgaggagaagctataactttgttttaacagttactagttcaacttgtaacaaagttaaaacttttttttttaactttgctcatttaaatatacagtggcctaaggaaactaagaaccaatcacagcagagtttgtgtaggtttgatggctaggaccaaccatgggaactgacgcatcatttcctgaatttagttgcgttcaagggtagtggtattcctgttctttgtctgacataactgtccacacctaaaagctgggcacagactttcccatctggtgggaaatatttcagaaacattagtgacacttgcagtgtcctgctattgctgcaaaacttgctcttccttcagcccttgccatggaattcaggtataattgtggtcttctattggcacatcctttatttacagacatacctcagagatattacgggttcagttccacaccaccagaaaagcaattatcacaaagtgaatcacatgatttttttgacttcctagtctataagagacttattttttcactttttaatcatagccattctgactggtgtgtgagatggtatctcattgtggtttttgtttctgtgttttgttgttgttgtttttgttgttgttgttcttgttgttgttgtttttgagacggagtcttgctctgtcacccaggctggagtgcagcggcgcgatcttggctcactgcaagctccgccttccgggttcacgccattctcctgcctcagcctcccgagtagctgggattacaggcgcccctcaccaggcccagctaatttctatatttttatagagatgggttttcaccatgctggccagggtggtctcgaactcctggcttcaagtgatccacccccctcggccttccaaagtgctgggataacaggcgtgagccaccacacccagcctcattgtggttttgatttgcattctctaatgatcagtgatgttgagttttttcttcatacgtttgtcccatgtatgtcttcttgacatgtatgtcacttgaaaagtgtctgctcacgtcctttgcccacattttaatggtggttttgttgttgttgttgttgttgttgtttttgttttttgttttttgcctgtaaatttgtttaaattactgatagattctggatagtagaactttgtcagatgcatagtttgcaaatattttctcccattctgtaggttgtcagtttactctgttgaatttcttttgctatgcagaaattcttaaatttaattacatcctatttgtcaatttttagttttgttgcaatcgctttggcatttttgtcatgaaacttttgccagatcctgtgtctggaatggtatttatgagcttaccttctagggtttttatagctttaggttttaagtttaagtatttaatccatcttgagtttattttttgtatggtataaggaagtggtccagtttcaatcttctgcatatggctagccagttatcccagcattgtttattaaacaggaagtcctttgtccgttgcttgctggagagattgcagagaaaagggattgcttatacactgttggtgggattgtaaattagttcagcaattatggaaaacagtgtggtgattcctcaaagaacttaaagaagaataaccattcaacccagcaaccccataattgggtatgtgcccaaagaaatataaatggttctaccataaagacacatgcacacctatgttcactgcagcactgttcacaatagcaaagacatggcatcaacctaaatactcatcaacagtggactggataaagaagatgtgatacatatataccatggaatactatgcagccataaaagattataagattatgtcctctgcagggacatggatggagctgggggctattatagtaggcaaactaactgaggaacataaaacccaataccacatgttctaacttacaagtgggagctaaacagtgagaactcatggacacaaagaggggaacaataggcactgggacctacttgagggaggtaggtgagaggaggaagaggatcacagaaaagtgcttattgggtactaagcttattgcctggatggcaaaataatctatatccctgttacatgcagtttacctatataacaaaccttcacatgtacctctgaacctaaaataaaatttaaaaaaagacctatgtttacactatactatagtttattaagtatgtaatagaattacatctgaaaaagcaatgtacataccttaatttaaaaatattttcttgcttacaaatgcaaataatcatctgagtcttcagcaagtcataatctttatgtgggtggaggatcttgtctggatgtcaatggctgctgactgatcaaggtggtggttgctaaaggttgagtggctgtggcaacttcttaaaataagactacaatgaagtttgttgcattgattgactcatattttcatgaaagatttccctttggcatgcaatcctgtttgatagcattttacccacagtggaactcctttcaaattggagtcaatcttctcaaaacctgccactgctttatcaacaagtttatgtaatattctaaatcctttgttatcatttcacaatattcatagcatcttcactgggagtagattccatctcaagaaaccacttactttgatcattcatgagaagcaatccctcattcattcaagttttatcataagattacagcaattgagtcacattttcaggcttcacttctattctagttctcttgctatttctaccgcatctgcagttacttcctccaccgaattcttgaacccctcaaaatcaaccatgacgactggaatcaacttcttccaaattcctgttaatgttgatattttgacctcctcctatgaatcatttatgttcttaatgacattcagaatggtgaattctttccaaaagttttccaacttactttgcccagacccattcacggaatcattatgtatggcacctgtagccctaaaaatggatttttttttttttttttttttttttgagacggagtcttgatctgtcactcaggctggagtgcagtggcatgatttcggctcagctcgctgcaggctccatcttctgggttcccgccattctcccacctcaacctcccgagtagctgggactacaggcgcccgccaccatgcccggctaattttttgtatttttagtagagacaaggtttcaccgtgttagccgggatggtctctatctcctgacctcatgatccgcctgcctcggcctcccaaagtgctaggattataggcgtgagccactgcgcccggccaaaatggatttcttaataagacttgcagatcaaaatgactccttgatccatggagtgcgggcatgaaaacgttaatctccttgcagatctccatcagagctcttgagtgactaggtgcattgtcaatgagcagtaatattttgaaaagaatagtttttttctgagcagtaaatcttaactgtgagcttaaaatattcagtaaaccatgctgtaaacagatgtgctgtcattcagactttattgtttcattcacagagcataggctgaatacatttagcataattcttaagggccctaggatttttggaatggtaaatgagcactggcttcaactgaaagtcaccagctgcatacagttatccctcagtatgcatggaggattcgttccaggactcagatgaataccaaactctgtgcagtccctgatataaaatggtgtggtggccaggcatggtggctcatgcctgtaatctcagcactttgggaggctgaggcgggtgcatcgcctgaggttaggagttcgagaccagtctggccgacatgaagaaacccccctctctactaaaaatacaaaaaaatgagttgggggtggtggcaggcacttgtaatcccagctactcgggagtctgaggcaggagaatcacttgaacccaggaggtggaggttgcagtgagctgagattgtgccactgcactccagcctgggtgacaagagtgaaactccgtctcaaaaaaaaaaaaaaaaaaaggtatgtgtggtatttgaatataacctgggcacatcctcccatatactttcaaacatctctacattacttatgacacctaatacaatgtaaatgctatgtaaacagttgtcatattgtaatgtttagggaatagtgacaagaaaaagttggctgtacatgttgggtacagatgcaatttttaaaaaatatttttgatccatggttggttaaactcacagatgcagaatccacaaatatagagagccaactatacttctaaattccataattctcaattttatcttttgtagaagaactggactagattatctctaaagtgtcttccacttctatatttcttccagtccacattaataggatcattgttaggctggtatctgtttctaaagtactacagagtaaatcaacaaggaaagcaaggttgtcttctcattcagaaggccagaggttgctaaatactccagttctgaattgtaagtgaaacagggaagttatatactaggtgattggtgtgctgttaaatgttttaaccttggctttgctctattaactttatctgtcctttttaaatcactttcagaaataaaataaggtgaatcacctcaagtggggtacaccaatgagttgagatcaatttgggacgtccttcatattgacctttgttgatacaaattatctttgtcacagaatattgctgtgattccattacctcctgttgtacttgcctgagcttcccattgttttagtcactctgcatcactgtgtacgatgtcaattgtgttttagatggttaaaaaaaaggaaaagaaacatttcagtcataccaaagtgttgatttgcaataaagagtataatttactgtggctctgggtattgattaatctatacaatgaaaatggcttttgagtgctttggttatcagttgaaattatctctattttttaagctgataattactgaaaaatgtcacaagtggaaaaaagggtgcaatacaaactagtgttttatccagatatctattctgcctgggaaaggtaaaaggatacacattatggttgcaatacggtctggatgtttcacttctgtgtatgtgtatttcttgcccatctcaaataataggtgggactttttttcacttttattttaagtgaaggggcacatgtgcagaatgtgcaggtttgttacacaggtaaacatgtgtgatgagggtttgttttacccattatttcttttttaaaaaaatttcaataggtttttggggaactggtggtgtttggttacatggatgagttctttagtggtgatttctgagattctggtgcaccctgacccaagcagtgtacactgtacccaatgtgtagtctcttatctctcaccccctcccaccatttcccctgagtcctcaaagtccattgtatcattcttatgcctttgcatcctcatagcttagctcccatttgtgagtgagaacttacgatgtttggttttccattcctgagttacttcacttagaataatggtctccaattccatcaaaattgctgagaaagccattatttcattcctttttaagacaaagcagtattcatatatatttgtatatgtataattatatatgtatatacacatagaataatatatatattaatcaacaagtgattaatgggcgtttgggctggtgccatatttttgcaattgtgaattgtgctgctataaacatgcgtgtgcaattatctttttcgtataatgacttcctttcctctgggtagatactcagtagtggaattgctggatcaaatggtaatatctacttttcgttcttaagaactctccacattgttttcagtaatggttgtactagtttatattcccaccaacagtgtaaaagtgttccctttttaccacatccatgccaatatctattattttttgattgtatcaattgttgcaggagtaaggtgatatctcattgtggttttgatttgcatttccctgataattagtgatgttgagcattttttcatatgtttgttgcccatttatatatcttcttttgagaattgtctattcacgtccttagcccacttttgatgagattgtttgtttttttctggctgatttgtttgagttcattgtagactctggatattagtcttttgtcagatgtatagattgtgaatattttatcccactctgtgggttgtctgtttactctgccaagtatttattttgctggtcagaagctttttagtttaataagtctcatctatttattgttgtttttgttgcacttgcttttgggttttgaagtctttgcccaagccaatgtctagaagggtttttctgatgttctagaagttttatggcttcaggtcttaatttaagttcttgatccctcttgaattgagttttgtataaggtgaaatatgaggatccagtttcattctcctacatgtggtttgccaattatcccagcaccatttattgaatagggagtcttttccctactttatttttttgtttgctttgtcaaagctgtaaacattgggctttatttctgaatcctgtattctgtcccattggtctatatgctgacttttatgccagtacctgctgttttggtgactatagccctatagtttgaattcaggtaatgtgatgcctccaaatttgttctttctgtttagtcttgctctgactatgcgggctctttttattttcatatgaattttaagattattttttctagttctatgaagaataatggtggtatttttatgggaatttgttgtgtttccatttgtttgtgttgtctatgatttctttcagcagtgtttgtagttttccttgtagaagtctttaatctccttcgttaagtatattcctaagtattctattttttttttttgcagctattgtaaaaggggttgagttcttgatttgattctcagcttggccactgttggtagtatagcagagctactgagttgggtacattaactttgtatcaaaactttgctgaattcgtttaccagttgcaggagctttttgaataagtgtttagtgtttcccaggtatacaattatgtcctcagcaaacagtgacagtttgacctcctctttaccaatttagatgtcctttattcctttctcttgtctgattcatctggctaaaacttccaatactatgttgaatagaagtggtgaaagtgggcaaaatcctgcactaaccaaatcccacagcatatcaaaaagataatccactatgatcaagtgggttttgtaccagggatgcagggatggttaaacatccacaagtcaataaatgtgatacactgcataaacagaattttaaaaaatcacatgatcatctaaatagatccagaagaaacatttgacaaaatccaacatcactttatgattataaccctcaacaaaatcagcatagaagggacataccttaaggtaataaaaagccatctatgacagacccacagacgacatcatagtgaatggagaaaagttgaaagcattccccctgagaactgttgtacagatgatttcatcacctaggtattaaacctagtatccattcgttatttttcctgaccctctcctcctcccaccttgtcacacaccctctgataggccccagtgtgtgttggtttcctttatatgttcatgtgttctcatcatttagctcctacttatgcctgcaaacatgtcatatttggttttctgttcctgtgttactttgctgaggataatggcctcgtgctccaaccatgtccttgaagaggacatgatctcattcttttttttgtggctgcataatattctgtgttgtatatgtaccacattttatttatccactctatcactgatgggcatttaggttgattccatgtctttgccattgtgagtagtgcagtaatgaacatatgcatgcatgtgtctttataatagcgtgatttatattcctttgggtatatacctggtaaagggattgctggatcaaatggcatttcagtctttagttgtttgaggaatcaccacaatgtcttccacaatgattgaactaagttacgctcccaccaacagtgtataagtaagtgttcctttttctccacaatctctgcagtatctgttatttttttaccttttaataatagctattctgactggtgtgagatggtatctctttgtggttttgatttgcatttctctaatgataagtgatgtagagtttttttatatgctttgttggccacaacatatatattgttggccacatgcatttcttcttttgagaagtgtctgttcatgtccattggccactttttaatggggttgtttgtttgtttttttttcttgtaaatttgtttaagttccttatagatgctggatattagacctttgtcagatgcatagttggcaagtattttctcctattctctaggttatgtgtttactctgttgatctatatatatatatatatatatatatatatatatatatatatatattgctgtgcagaagctctttagtttaattagatcataatcttttatcgtatcccttaactcaaaaaaatattgaacattaaaatattggtagcttttttcccactatcaacctccatagtaaaactatagttaggctttccttcaaatgaaaatccattcattttttatactgtttgcctgaaacaacacagtattctttcttaatagtattttcatgttgagctaaacaaacaacatttaaataaggaaaaaatattattatttcttttttattatactttttttccttcttctttctttctttcttcttttttttctcttaatatatggggtctaactctatcacccaggctggagtctagtggtgcaatcatagctcattgcagtcttgaaatcctgagctcaagtgatcctccctgctcagcctctgagtagctgggaccataggtatgtgccaccatgcctggctctttattacatttctgttataatattttctctattatatttcattttagttactaaagaatatgattttgaacttttttggaaagatcatcattttactctttgttgtagaagaaaatctatgatggtctaatgaactacggaaatattaacataattttaagaataatacatatatttgtattaccaaaggctatgcttattagtcattcaaacttcaactaattttttctttcatgaaatactcagaagtatctattcaccaccaccaacactccctccatcatttaatttcaagcagacttgggtttattcctggaaatgattttttactagtgttcttaattttagtcttcttctttctccaatatcttaaggcagaataatttttcttaaatgcaactttcattctttctccataaatttgaggtatcttcacatgaaattgagcttcaaagaagatgaagatgagtaagggccgggaaagccagggaaggtttctgtttcctgtgtatcaagtttcccaaacaagaatcttggagtcctcttcagcttctgcaactccttctcgatcaacatgcagtcaaacttcaaattgtattgacggaaactcagaactgcttagatcattttcttactctcattatttctgcgtggatttagacattcattgtcttttgcctgggctcttgcaataggcttttatcttatatcctaccgtaaaaggtttcagatgctacacatcctccatactaccaaagtaataggtaaaaaataaatctgattgtgtctgtacaaaaaaacctgttagaactaataaataaattcagtaaaattgcaggatacaaagtcaacatacaaaaatcagtagtgtttctaaacactaagaatcaactatttgcaagagaagtcaagacaacaatatcattttaaagcatcaaaaatattgaggaataaacttaatgaggtgaaatatctgtacaccaaaaactataaaacatggattaaagaaattaaataagacacacataaaaagaaagatatcccgtgttaacgagtggaaagaattaatgttcttaaaatacccagagtacttaaagtgatctgtggattcaatgaaatccgtataaaaattccaatgacataatagatattttttaaatcttaaaattcatatggaatcacaagttaccccaaacagtcaaagcaatcttaagtaaaaataatgaaacttggttgcatcacactgcctgatctcaaaatacattacaaagttgtagtgatcaaaacagcttggtactggcataaaaatcagcacacaaatggaacagaaccaaaagcccagaaataaatccatgcacttatggtcaataaatctttgacaaaagtaccaagaacacaaaatgggaaacgaacagtctcttcagtaaatgatgttggaaaaacttggtatccacatgcagaagaatgaaattggacccttatctcacactatatacaaaaatcaactcaaaatggattaacaacttacagaacacctaaaactgtaaaagtactagaagaaaatataggggaaaactctatgacattgatctgggcaatgattttttgaatctgaccccaaaatcacagaccaaaacaaaagaaataatcaacagaatgaaaagacaacctacagaatggaagaaaatatttgcaaaccatatgttcaataaggggttaatgtctaaaatatgtaagaaactccaacaactcaatagcaaataataataataataataacctgattacaaaatgggcaaaggacctaaatggacatttctcaaaagaaggcatacaaatggccaacaagtgtatgataaaattcccaatatcactaatcatcaggaaaacacaaattaaaactacagtgaaatagcacctcacattcattaaaaatggctactatcaaaagaacaaaagataagcgttggtaaggatgtggagaaaacaaaagtgttgtacactgttggtgggattgtaaattagccatcatagaaaacaatatgtaaattcctcaaaaaagtaaatacagaactattgtatgatccagtaattctacttctgggtatatacctagacattcaaagaagaattggtaccaaccctactgcaactatttcacaagatagagaaagaaggaatccaccctaaatcattctattaagtcagtatcacccaaataccaaaatcaggaaaggacacaagaaaaaagaaaactgcagactaatgttcctgatgaacatagatgcaaaaattctcaacaaaattctagctaagcaaatccaagggcatataaaaaagataatacatcatgatcaagtgggtttcatacccgggatgcagggatggtttaacatatgtaactcaataaatgggatacatcacataaacaattaaaaataaaaatcatatgatcgtcttaatagacacagaaaaaatgtttgataaaatacagtatccctttatggtaaaaaatcctcaacaaaattggcataggagaaacatacctcaaagtaataaaagccatctgtgacaaacccagaaccaatatcatactgaatggggaaaagttgaaagcattccccctgagaactggaacaagacaaggtgacaaaattagtgtgataaagagatatttacactgtcgtgtttattgcagcattatttccaatagacaggatacggaatcaacctaagtcttatctgtagatgaggaacggataaagaattgcacacacacacacacgcacacacacacacacaatgaaatactcttcagccttaacaaagaaggaaattctgtcacttgtgacaacatgaatgaacctggaggacattaggttgagtaaaataagccaagcacagaatgacaaatattgcatgatgtaacttaggtatggaatctaaaaatgtcaaactcacagaaacagaaagtagaatggtggttaccaggggctactgggtagggctgtaggggtggaggaatggaaaatgttggtcaaagggtacaaaagttcagttaaacaggaggaataagttctggatatctattgtactatgtaatgactgtagttaataatactgtgttgcatattcaaaaattgctatgtgtcgattttaaatgttctcaccaccaaaatataaatatctgaggtgaaggagatattaattagtttgatttaatcatttcacaatgcaaatattaagttgcacactgtaaatatatacaatttttaattgtcaattaaatataattgaaaaatagaacataataaaatattggattattaactctatcaggaaatgaagctttgagtaacattttactgtttatatttatggttttagccaccaagcaaacatggtggtcaagaacttggactcacattcaggttgccatagtccaaattcaggcttccctactcactaatgtgttcttaagcaagaaataaacttattttggcttcctttggtaaaatgggattaataattgttcctatcctacattttattgtgaagattgaattaatgaaatatacacgtaaaacacttaagacaattcctggccttagtaagatttcaacaaaaatggtcattattatgatgctttattctgttacatttatggattattagacagataaaattggacctcatatgtgaccattctattttcctttattcaaatggaaaaagaatgtcaattcaacatagggaaatactatatatgtataaattattacttaaatttatgtttttacttaaatatatgtttattaaaatcaagtgtttaaatttatatattaacttttacatttataacatcttatttcttctgaaaacaaccaacacaacccatttcttatcagtgataattcaaatggcctctttattctttcctgaatttttcaatcccaattcttctcttctgttctttttcagcagcatcttgcacagggctttatggaaaagactgaggtgctgtggtgaatttaatctcctctgttgtttactttaatctcttcatccagttactctgacttttctccatgcttaatgttatccctcttgatttcacagcttaacaatttcttctttgttcttgaccccatcctagccttcttatttcaaaagtcccctcaagcaagtttcttttcacattcttaatttcttattcttaataactccttttttatgccttcaagcaagtatggctctctctcatactgaaaatgtgctcttccgttctattttgctactgtttttattcacttaacagtaaatttcaaacaagttttgtgcacctaattctttcatttctttacaacccacccattgcttatccactcttacagctgtactagaattgtaatttaaatatgtatcatatcagtttttttgtaacattgataatttataatatttaacatattttgtaatagagttttcttcttaatattttactttccttttaaaaagcctcagcaagttgccattgactttcggcattgtatttgatacctctggactctggctactatcgccctttctgtataaaatctgtaacttgaccaaggcaagaacctccaccccaggccaactaattttctcatctgctattgtcccaacctgctttggtttctcctataggtcagagtcaggtcctgcttgggtttgggcctttgctcataattttcccttgcaattgaaatattctctcactccaggccagcctttaaagcctaacgtaagtaccaccacatccacgaagcctctgcacatcaacttcagatctcaatgctgttaaccttttataaacaaaaagcaatatagaataaatcctttttgggagcaggagtcaaaatgctagttgcagtcttgcatctgtcacttatttgcttggccagtgacgtagccttattaaaaactcaatttctttatccaaaagatgaggatgtttatacctccctgatctaccttctaagattgttgtacatgataagtaaaatactgtgcataaaaacatttgtaaaaattttaaaaatctgttcaagcttgtcattgttaccacagataaatcgggtactaccttgctgtcttggattgcttttgtatgttgttctcttatgttgttactggactcggtgttattacttaaatttctctgtatttattttgacaacttaattaggttttgaattctttggaagcggagagtatgaatggtattatgagcaaagacccagaaggagccacctcctaattattttggagagaattatctaagaggcctaattggacttgtgcttcccattaaagtatgattcatatcagagaagcttacagtcttattgctggccacatggagatagtacataggagatactcgatgggaattctgtcaactgaaagagagtcagcaagacagtgtaaacatggttagcgtgtctcagcttacccagcctggcttggtgtaaccaatatagactatggaaaataggaagtagacaaaaggtagtggagattgggctcatgccattttctttaattgaaatacaatttccataaaataaaatacagatatttttaagtgcatattactttgagttttgacaaatgtattcccctgtctggcaactgctccaattaagatgtagaatatttctatcaccccagtacccttttcctgtcaatccctccttctcccagagacaatcactgttccaatttctatcactatagcttagttttaccagttcaaaaacttcacataagtagaatcataaagcatgttactttttttcctggcttttgtcacttaacagtttttttttttagatttaaccattttgttgcatatgtaagtatatcataactttttgttgttgagtagcactctcctatataagtatgttataataatgtttcatttacctattgatgagcatttgagttgttcctaagttttaactagtataaaaaagtttactatgaacattcttgcataggtctttttgtgggtgtatattttcactactcttaagattgtcagactggataaagagcaaagttcagtggtatgctgttttcaacacatattttaaatataacacagacaggttgaaagtaaaaaaatcagtaaaagatacagcatgaaaacactaagcaaaagaaagctgatatggctatatgaatatcaaaaaagtagattttaagacaaaggatactaacacagataaaaatggtcattttattggggaaaaaaaggccaatttgtaacaaggcatgacaatcttaaaagggtataacaaagtagaatttcaaaatccaagaagaaaaaaatggcagaataaagtaaaaagcagagaaatccacaataattgttagagattttatcaattttatcccagtagttgctagaacaagaagacaaaaaatcaatgatatagacaacttgaataacattatcagggatcaaacctgcagacctaactgacatttatagaatattatacccaacaacttcagaatatacattcttttcaaatacacatggaacattccacaggtggtgttatgctaggccataaaattagtgacacttcatttcaaagagtatttgactacaatggaattaaattagaaatcaattacaattagatatatagaaaaggcccctttttacaaaattaagcaacagacttctaaataatcaatccatggatcaaagagggaaatcacacacacacacacacacacacacacacacacacacacacaaatacagtgcgctatacggagtgataattagaatacaacatgttaggaatctctgtgttcatgcctttaaccatttcatattatttcataataatcaagaacttattaatcaaattagcatttaattatcttcagatgaaatgagaaagagggtgggcaaaatgtagactgaaggctgagaattataggaattatggtcacaatcagccagtgttttaactctactgcaattgtaacaaagtcattggatcttggttcaaccaatgggaatagatcctttcaaaatgccaataaataaaatgctaaataaacattttggcaattttctcttgataaatctcttatagcaatgtgcataatgcttccattttcatccaatgaagtactagtgaaaatagtctagatagtgttaatattgatagaaattataactaaggaataagttagatggtgattaaagagttgaataagcactcaaagaaagttgtgaaatctctgttctgagatatgtgacaaaaccatctgtctctgattttagtttaatccttaatgaatataagaagcctgactaaatgatctcttgggaggcccccttccaaacacaaaacccattattttaatttgcattggttatagtgccaacacaaagaaaaaacacactcaagatcttttttataaagtagggatttaattctaaatcttagtcatatcttacaatttataaattctttaatgttgaaaaatattttctttgtagaactaaaaccattctctctctctccctccctccctctctctctttctctctgtctgtttgagaacccaaaataaaatgtagtttataatttgtgattatgatttgaacttttcaaaaaatgtatgagtcatttcttgccctttgataatttccaaatgatgatgctttgcttttgcttttagagatcagtctttgcttttaattatttccatatattttggttgggagtgagaaaaataaacggaaaatgtcactcatgagtgtcagcctggtaatgaatatatagaatgcaaatggtcactttactgggggagacggtaagtttttctgagccttttgcccttttatcttctccagcctgctgttttttctgttttcatttgtagattaaactggtgcagcaatatggtggggtagaaatcacatgaatctgacatatgtgggctcctgtatctgtgcacatggatagagatgctggtcaaaatccaaccatcttatgagttccagacatacttttaaaattcacatgcatgaagctatacaaaatattttaaaatacagaatccaaaataaaatttctttttgtataaaatactccttctcaattcattcctgtaggcaaaacttgatatttaataatattaagaaaaagaagaaaatgaattcgaaatattttattgctttacaacacaaaaaaaatggtttacttactcccaataatctgaatttattccaatagtatatttatggatttaaccaggagagggattatccttattctaagtaggggagaaaaaattaaaaaaaaaaaaaaagaaaggaaggaaaaactccagtggtcaagagattgagtgaaccgaggaacagagtggttatttgttctctgtaatgtattaggaatgactggaagtaatggaatatgctagtgaatatagctacccctatattgaatagaaaaatacattaccaaaacacttttcacacacgaaaacaaaagaacattttgtacaaatacctgatgtgtagctatatcatttagttgctactattgcctagtttaaaaattgtaccctggttaaaaacagaatcccttttctaatcttttaagatttcaacaaatatttccaggcattaaggacaggcagtattttgccttgtccacttctctgacgtctagctgtttctagttgctaaatttggctgctgtacttttcatatccgtaaagctgttcttgggtccaccctgcaggcagccatccaggtttggatttttccgggcagcccgggcttggctatcctgctttcatcatcctccttctgttctcaagccaaggacatagaatggcagagagctcccctttatttctggtatgattgttgcttctccgggtctggcttgggctctgatcttgacatttatgtcacaggtgtcactggtgaaactgctgtgaaaccagatggcaggcctaactgaggttggcagcaactgctgttgtccccagtgtcactgctacctgctctactttcttattcctgttgatgttctactgccttgttttattgcattcgttcaatgttaccttccaacaggccttttcaaatgtgaacaccattccataactcttctgatgcattaattccccatggaacccattcatctagggaggctcatgacttggctagattctccactttccttcagggcttttgttaaacctcatttcttcagcaagcctctccatgaccaccctatctaaaattgcaatacatccttctcctccccaaccctgattattttttctctctttttcataaattttctttccctggagcaatttgtaccacatgtcagaatctatatttgccttacttgggcattatctgtatccctccactgggttacctagaatataagctccacaagggcaaggttttgtctgtttggttcattactgtatcccaagcatctggaagaagactggcccttagtagacatttcaaaatttttgttaaatgattagctggattgtaaatactgaaagattaggtttattgtttttgatttggtttcattcattgtgcttagtacagtgctatatgtaagagcttgaaagacagagaaaagagcattagtagtatctgttatgtatactggatgttttacttgagttatacccttttttttttccaagacagagtcttgctctgttgcccaggctggagtgcagtggtgtgatctcggctcactgcaacctccgcctcctgggttgaagcaattctcctgcgtcagcctcccaagtagctgggattacaggcacccgccaccacgcctggctaatttttatatttttagtagagacaggttttcaccatgttggccaggctggtcttgaactcctaacctcataatctgccctcctcggcctcccaaagtgctgggatggcaggcatgagccactgcactcagccaagttatactctttaatcctcacaataatctaggtattttgaccaaagaaccacagctagaaagtaggagagtaagatgtaaaccagttttgtctggctctaaaattactgcctttttttgtttgtttgttttgctcagaagaattggtcatgccaaatagtaataagagttcttcaaaatgaatgatatttcataataaggtgtagctagaaacagtttgccaaaaatacttaggaaaaaaaaaagatttgtgaattagctccctaaaaatacaaacgcaacaattccaaaagaaggaattccaaagttattgggccatagtacttttgtgttaagtgcctggccctccaaggtaactaattttaatttaaaaaaaatgtctggacacatattttgacatgttttgctgaaaatatatttataatatgagcccaacaaagacaaatagattcattcttggtgctaaaaaatgacaagaaaacttctacgccattgctctcgaatgctttcttcattgtagtccaagaaaatttgattagttgtattttaaaagtaagccagatttcactggtaaggtctttccttacttcatcttctcccttgacaccttttgatttggttgtacaaatgcaggttaggccccattattaattcagtaccacatatttatgaagaccccacatgatgcaatcagcactagagactggaagtttttcatcaagcccagtaagcccacagtaaaaaggaatcagtctcaatcactcatcaggaagctaacatgttctgtgaccaccttctggatgttgagttatctctaatccagagtttatgtcaatgatcttaaaaattagttcaattctggatgggcgcggtggctcatgcctataatcccagtactttggaaggctgaggtgggcggatcacgaggtcaggagatggagaccatcctggctaacatggtgaaaccccatctctactaaaaatacaaaaaattagacaggtgtcgacagagcaagactccgtctcaaaaaaaaaattagtttaattttgtcttcattttttcttacttagtaaaagataatgtaatgcctggtgtttttttaaggcaatcatagaatctggaggttgaaaatatttggggaattatacattctaattattcagacaggcatccttactgcagtatctgctagtaattgaggattatttcatatttaaaaatactcatatttttatgcaaatctcagaatttgaacattgttacttataattgttaaaaagtaaattgagaaacaataaaatgttaaagagcttatttgagcaaatggtaattcttgaatcagctccaaaccaaaagtggttctgaggccacttgagagaactcaaagagaaagcttttatagggagaatgtagaaataaagcaaaggaaatatttaattggttgcaattatatagttgccttatttggtctatcttgctgaaaagttcctacttgtattactacatgagttggcagcttctgattggttagccttaagtttcatttctctttaggcatttataagaaatagttcaagttgagttttgcatatgtttgcaaatcaagcaaagtttaggttacttctgagggccacttggatttgtctgctcagaacttcttcaagcctggtctgttttaatttacttcaacatattttatcaacattttgctttctataacattcatagtaaccttagatctgccctctagaatcgacagaggctatttcacccccagcctcttttcaacatgagagtttgctcaatgctgcttctatttgaaatcttctgttattcagctcttttaatgaatatctactttctgcaaggcattgctttatgtactgcaagagttacaaagaggagtacatcataatcttacttgaaggcaattacttaaatagaaaaaatggtgtgtgaaaaacaaatgttcttaagcttgaaaaagtgaaagtgtgtacccagctggaaggatgtgaaagtgtgcatggaaaatgtatttgagatttaaactgctgttgtcttctgggttgaattggtgtcatgaacttcaggtagtgaaaatagcttaaacaatacccctgaagtggaaacacagagattagtgtgaaaatttagaagaccgtgagcacattatattttgtgtgtaccataagacactggtagagtatattagtccattttcttgctgccataaagaactgcctgagactggaaaatttacaaaggaaagaggtttaattgattctaagtttggcatgactggggaggcgtcaggaaacttactatcatggcaaaaggcaaagaggaggcaaggcacctttttctccaggcggcaggaagaagtgctgagcaaagaggggagagccccttataaaatcatcagattttgtaagaactcactcattatcacaagaacagcactggggaaaccacccccatggttcaattacctccacctagtctctcccttgacactcggggattatggagattaccatttaagatgagatttgggtggggacacaaagcctaatcctatcgtgggggttggtaagagggaagactagaaaggaaagctggactaggcaaagtggctcatggccataatcccagcagtttgtgaggccaaggcagggggattacttgagccaggagaccagcgctggcaacatagtaaaaccccatctctacaaaatgttagaaaattagacaagtatggtggtgtgcactatagtcccagctacttaggaggctgagatgggaggatctcttgggcctgggaggtcaaggttgcagtgagtctttatcacaacactgcactccagcataggcaacagagcagaaccttgtgaaaaagagagaacgagaaaagaaaaagaaagaagtcaagaaagaaaggcaggcaggcaggaaggaaggaaggaatgaaggaaggaagcagggaaggaagcattctttacatgccaggaagaggaatcttagtgatgagaaaactgagtctctgagagtttgagcctcactcaaggtcactgagttgctaaatggcagaactggatttcaatcccaataatttgattcaaaacccatactctttcccatataccacattatctaggaggtgtcccaagagttctgaagggggagttagcttccatctcaggagacgaagagagtcttcttagaccaaatggtatttgagataattttgataagtttatgttgaattcattggttgagatagggaagacaattcatttcaaatggaagaaactgagcaaaggtacaaaggggaggaagtggagagattgggaacagaaaataattaatctttggttgaacatcatcaaaaaggtataaaggatggaaatgaaagctaagatcagagcacaaaaggataacatatttgaacttttacttggacttaaatgataaagtttttagacagattattattataactacagccaagtttttaaaaatattatattagtaattatatataaaatagatggatgggaaacaaacggaagaatggagattatctgtttagagtaacccagttaattataataaaatattgaatctgcatgttggcaatggaatgagaagggaagagatagatatgtaatttcagaagcacaattcacagaacttgatagagattagtggaaggaggagggagatagatgacattaattctgtgatatggtttgcctgtgtcccacccaaatctcattttgaattcccacgtgttgtgagagggacccagtgggaggtaactgaatcatgtgggcaggtgtctcccgtgctgttcttgtgatagtgaataagtctcataagatccgatggttgtataagggggagtttccgtgcacgagccctttttctttgcctgccaccattcacgaaatatgtgacttgctccttcttgccttctgccatgattgtgaggcctccccaaccaacaggtggaactgtaagtccactaaacctctttcttttttaaattgcccagtctcaggtatgtctttatcagcagcgtgaaaacagactaatacattctgtaaatttgaatgcaggagatagaacctttaaaagcaatggtaatttgtcttgcaaggcctatgtttatctctactatgtactcagactattgtacagcctggaccatagaaggtatgcaatacgattatttatctatgtactcaatccctactctgtgccagggattgtcctaagcactagcgatagagtaaaaagaaaagaaaaaactcttgttctcattagtaaaataaacatcacgttgcttcacccaaactagatcaccttagtcccttttattgttatctctgtgtcactctcctggcaggtgagtgtttctgcttttaagaatctgtacctgtgtcttgctttagataactgtcttcagattatctgagtcattttttccacttcagcaccaagtctgaagtgccggtgagtttacgtgcccccacccatatccttagcgaagactgactattgcagtcttgtgaaagtacagatcccttgcttcatatagggacaaactcaaatacataatttgtactccaaagttgtcctgtgggatcataataaagccacttctgtagggctttgtttggaattacaccttagcttggctccttccccatccagacctgcagctttacccactcctttcctgattgatcctaggagtacctccttaactaatcactttcccattaagccacatctcagtgtctgtctctggggaacctgacctaagacatgtagtttacattgcaatgtacagagacaaataataaacaatataaataattattaataagtttcatactaggccgggcatgttggctcatgcctttaatcccagccagttgggaggccaaggcaggagaattgcttaaagccaggagttcaagaccagcctggccaacatagcaagaccctcatctctacaaataaaataaattagccaggcaaggtggcatgtgcctctagttctggctacttggaatgctgaggtgggaggatcactggagcccaggaggtcgaggctgcagtgagctttgccactacacactagtctgggcaacagagcaagaccctatctctaaaaaaatagatattttattaggggaagttgaagttatagagggaaataaggaaggagatgtggttagagtgtgtgaaagtgtgtgtgtgtgttttcagttgtaggggatggtgttcaattttatatagcatggttggggaaggcatcactgggaaggtcctatttgagcaaagactagtaggtgctaagggaatgagccatgcaaatttctgggaggaaagcatttcaagcagagatgaaagcaagtgcaaagccatgagctgggagtgtctggagtgcttggtgagaagtagccatgtgagaaagtacagggcaggagacgacatgagagaaggaagtgaggggggtgggcagaccttgcaggccaacacaagccatggctcatactttgacttttcctctgagtaaatagagagtcactgtagagttctgagcagaatagtgactcgactgtttttgcgtttcaaaggaatctggctaccacattgagaataaactgaaggaggccaaaaattaagcatggagaccaatttagacattattaccagggctggcttcgtgggcagccacacaaggctccatgctaagaagggccccacacatggagcctaatgctctgcagtcaccatcttgataattttaataatttgtgtttgaatttaggttttgtaagtgaaagtcatgggactgtggagcatgttctgggtgctcagtgtctggtacttcctgctgtggataggttcaacactacctgcacccctgctccctgcccaggccactcagtgccccctttttcacctttttccagcaactattgccaccctccaacagggagaatgctgggctgctggtgggaagatgtctgtgttctgctgcccttaagcctgtcggggatttgatcacaagctcaggtcaagttgcagttaggaatgcacctcaggctggaagtgccaaggcaggtgagagactcagtgggagagagcttctcacccacctctaatccaggcatgtcaggtgcagagttccaatgctttggggggttgaccttccaccagtttgggtggcaggctcatgggaagggtagattgacttctctgaccccaattgagggcaggttgcttcagtccagcaactggtgggaaggggaatttggcagtgggggatgggggcagacattatcttctgctctgaatcagggacactcatatggctctgtgtttgccctgcaagtgtttccctgctccaatgagtacaacattaaatagcaaataaaagccatcagatcagtagacagtttgcataaataagaaaaaagctatgttgcataatcttttaatggcccctttttcctgctacttaaacaagtgtcttcctcttttttttagagacaggtcttgctatgttgctcaggccagtctccaactcctagcctcaaggaatcttccagtttgagcctctggagtagctaggattataggtgcaaggcactactcgcagctggggcctcaacattatcagttttgcactgtacttcataaattactggccctagcaattgcagtaatctaagtgaatgatggtggcaacttgaaccagtgtgctaatggtagaggaggtgagaaatgattggatccaagatatattttgaatatagaacaaaaaggtcactagaggttatgacatagtgtatgagagagagaggaaggaatcaaggatggctgtaaggtttttcacctgaggaacttgacattatttgttgaatacataaatgatgtgtcctgttatgtatctgttcatgaaacacattgatggtaatgaagatgcagtggcagaagcaaatcatagaagtatttcctagcggtagaaatattaagacttggtgacaaagatcataaattaaaggaaagggagtgaaacaactaagtcaggaaaaatacttctaacttaggaaaaaagaagaaaaaggaaggaaatggaaatatttaacaaatggtataaatttctaaggaagataagttcaattttggaaatgttcacctgaggctccaagaacctacagcccaggagaccttagctataggttgttgggaatatgtgataggatcctgaatgagcactcaggactagggatctatgttgagggcatcatataagtgtaagctggagtcacaagaatggttaactcatcaataaatgaatatgaggagagatgtatacagtattgcagaagagagttccttgtaaatgtgtaagctcatcctccatgcctgggataagagtacattcattatggtgcatgtgaaggtattgagaaaacaacttccgctttctggcagaggttaagctagtcccataatagcaatagcaagattataaggggaaactatgttatttgtactgggtcacaaatttgtctaatagcagtggacctgtgggattctataaacatcttaggtatagaaagggatccagtgacttttagaaaatcagacttatatcatatttcccttcttaacttgtagctcagtggtgcatttcttaccctgggggagaaatggaacatggactatatttagtatttgaaatcagacacatgtgaatttaaactctggctcagagtggcaatggcaaattattcaacatccatacaccctgatcactcccacatttgaaaagtgacaacaatactacttccttcacaaataatgcaaggatcaatgagataacaaatcaagaagccagtagtgtgccacaatttaggtagtgttgacattacatgaagaaatgaacccatggtctcctatgctctccttcactcctctctagttctctctctctctctttctctctctctctctgtctgtttttctctctctctcatacacacaggcatgcatacatacactttggaatgtagctattttttgagcattgttttattattatttaatttatttatttatttattttttgagacagagtctggctctgtcgcccaggttggagtgcagtggcgcgatctcggctcactgcaagctccgcctcctgggttcatgccattctcctgcctcagcctccctagtagctgggactacaggtgcccgccaccacacctggctaattgtttgtatttttagtagggatggggtttcaccatgttagcaggatggtctcaatctcctgacctcgtgatctgcccacctcggcctcccaaagtgctgggtttacaggcgtgagccactgcgcccagcctgttattattattatttcaaagaccttctgatcctggctctacctgctcattcatggggaagatgcccagacattcagatctactgttccactgaggagtttagaggctgctttttctcccccataaaagagaatggggactgatggaaaaattttaggtagaagtctttgatgaaaagaagaaatgaggaaaactgagctggaaatattcaggtatatcaaacaagtggaaatacctcaccctcataaagagaaccatatcctgggaaattttctttcttacctgattattaaaatccagaattggaattctgtgattccagtataatccatccatcaaaaccaaactactatgtaatcagattagaggtggccttcctgctgatgagccatttagagacggttgaatgagttcttggaagtctgctaacatgcacttaatacatctgaagattttaaaacgttgcagcaatgtattgccagtctacctacagtaaaataaaaatgcttccattaaaatacaggtatatttcttttatatagttaacttatttttcctaggaaagttagatgtaaagtgattatctatacactgaatcatatttcccagagatcatcatagtaagattggtatgcatttctgttaaagaaaagcaaaatgtgtcttaggacataacaatcatttaatggaatatctaaagaatgttggtcaagcattttgaacaagatgaagatggaaccagggctgggtgtgggcagtagactgttccaccaggagccaaagatgacagtgaatatacacttgacatcagtcaccaatgacaacctaattctacgtggcatactggcctggatcaatgagtctcctgaagttgaatttgacaaagatggaacaattgtgctcaggggctgcttattgttgctttatggtcatcctcttccctggctccattgccttgaagaaggtgaaattccatgaatacattcataacttcaaaatactacaagcagtatttttaagagggtgggtgatgacaaagtaatttctgtggacaattaggaaaaggaaactttcaggacaattttgaattcattcagtactttaagaagttttttgatgcaaactgcaatgaaaaagactataaccctgtggctgccggacaaggtcaagaaactgaagtggctccctctattgttgctccagttctgaataaaccgaagtaacctctcagctctagcaatccagctccacataggaccatttccacaaataactgcagcttctaaggctgcagcttctaaggccccagggtggtattaaaaaatcctggtgtgggcagtaggagtgctgcagggtcaaattgatgctagcaggtcagtgtattgaaacttggcattgaagccttggagaaagagatttctacttcagaaagctaaggaacaatgaattgatttgccagcagaacgaggggcaaaatgaccctgtattgcagaggactgtagacatgctctgtgccacagatgaagacttcgtgatatccgatgaaaggggcccacaggaggaacaagaagagttttaacaacccgaaccaggagagccttatccgaattctgcactccaaatcttgtgcttaactgttaaatactcccttttattattcttagaagactcactggtttctttttatgagcatgaagtacctctttttaaagtgcattttgcagagtttcactccttttttggtgagtttgagttgggagttttactgtgcagcagagcaacattaacatctggttagttcacctgggaaacaaagaggctgaacatggggctcaccatgtgcatgtaggtaacattgattgctggagaaggtgtttggtaatatgccgaagtggagaccttggtacagaaatgtgaagactgaattgaattttaacctaatgtgaaatcttggtagagaattttgtaataagttaatgcctaaagaatatttaaaatatgcttccatattcaaaatatcaaatgtaacacatcagaacatcttatgtgtttgacattgtatgttggaaggaagggccagacatcagaacctttggaacctggtgtcatcacaggccttacagggctgcttgcaacctcacaggcctagactttggccccaaaggaaagttctaaatgttgctctgtaaatccatttggtgtcattgaccaactgcatccaggctaaaaagcaagaggtattgttgcctggatgaacacagggtgtgtttcagccctgagatttttgggttgaagagctctattttcattgaggatttctctggaaatttttccaattatctctgaaatttctatgtattacgcttttttgggaaatgaggtgtgtccaattctttcatctaacaacgcttttggggatttgctcacatctctgagatttgaatggaggttgtttcccattttaccatcctttagttttacatttaacatgtcaccagtggtgaatccatagaggtctgcagcaaacttgatccttgcctcgttggaggaaagaatttggctgaggggaagaagtaggtttaaggtagagggagagaccgaggcaagttttagagtaggagtaagagtttattaaaaagttttagagcaggaacaaaaggaagtaaagtatacttgggaaaaggccaagcaggcaacttgagaggtccaagtgccctgtttggcccttgacttgaagttttatacattggcctagttatggcctggttacggcgtttgcatctctcttccctttattttcttttggagcaggctgtacacatgtgcagtgatctgccagcacttgggaggggcaatatgtgcagtgtgtttactgaagttgtgtgcatgctcacttgaggcaattttcctttaccagtagagtgttcctgagaaggtcatatgccagttaaactctgccattttgcctcttaatgtgcatgcttgagctcactcacccaattcctgagaacttatcaggaagcctctgatcaccaggttcaggtgttttttttttttaagccattaggggactgtctttacctggtgctggctaagaccaattattattttagacagtttagtaaccacctgaccgtcatctgatggttgcctgacattcctgagggaggggctctctactgccttgctcatgtctgcctaactacctactctaacattgcttctcttctctgctccccttgcccactggggacacctctttgggttcttaaagtttgcagcttggagttggaagtgcagcaggcaggtgggcacactgcaaattctttgtggacctctggcaaagggaataatcagggaaggctctggttacctctgcaaagctgggatgtttttggtatctgctgtccacagctctccagttctctgaatactttatcagtacactaatctcttaagagataaaatttattagtgtgttgctaaatgttcattttcttttacagaaaatacagtaccatgtctgaattattcatatttaaaatttgttattccttaactctccctcatttgatttgtgcacaacctattccatccttttgtttggcagaagtttgcaaaatatgtgtcactcactgagattgttcagcccctgatgcatttgtattgatttgtgtctggtgatagcttgtcctaaaatgtgtgtaaaaagtaaacattttataacaaaattgttgtttaatggatgctttgtgtggaattcagagaaaaatccagattcagtgattaacaatgccaaaaaatgcaagtaaatagccattgttcaaatgacagtggtgctgtttctcttttgtggttttttagacttttgttacctaaaattctgctttattagcaactcatttttcacctgatgtttcttgacaggctttttttttctattttaagtagtttctaaataatttttttttatttcaagaaagagaaaaaagaatattgctcaatgcacctaatataaaaataaactataaaaaataagttagtttcatattggaactaaacctagcattaaaaaaaaaaaacagcttttctcaccagtaaacactgaacgtgagttcttcatattctactattctctgtttctactctacagcagaaaaacacgtaagtctggttgttcagaactgtctccccattatggaaattgttagttacagaaatgggctagtggattcaggttaaaaagagaaggatacatatacatgtgtgtgtgtgtgtgtgtgtgtacatatgtgtgtgtatatgcatatatacaaatatatatcacagcaagtaacaatcaaaaagttgataagaaaatagacttgaacctatggaataagaaagctagaatatctgaaaaataagtattcaaataatatttagcaaatcttttattggtttatgtttacattactgtaatgtaccaaagaacccaaaaaactacaattgtagaacagaacttaaaaggccacttccagaaaaaaagactttccttagtgttttcagctttcttaattcttgggcacaaaattttctaagtctttgcgcacttatccacaaccactaattacaatataaactaatataaaattatgtcctcatctatgaaatttaatatgccattttcttagtataaatttatttctagagcatgtattattaatgtggatctttgtagaaaaaaattgtggtacaatgtttattactacatacccttatttttttaaattgtcttatctttcatataactttttgctgatgtcatcatgtgtaataacatgattttttaaaattttaatttagaaaaaatatattcctcttgtataaatgagaaaactaaaggaaaagagtatcgaaaggaaaacattatagaaatatcagaatttagaatcccaattcttaagattttttattttctgactacttcaaataatatcgtttgcctttctcattattcatgggtcttccaaatatagtgtctggccttaaaagttgtaacacaaaatcttctgtctgaaatgtagtacaactgaatgaaatttaaaaccttcacgtaatatatgtcatatagaactctcataaaatatcagtatgatgtgataacaaaggtcagaacaaatggaagaaaaaccaatgtatgatttctgaaaaccttatcctgggaaatgagaaacagactataattctttacttacatctacattatgcaaaagtatctttgatgtgaaaaaatactcagtgttgttcattcgatgttttatatgttttggtaaaacattttgtgttcacccttttaaatattccaagacacactcactggctagaatcaatgggagagaaagaggtgactctataactaatataatgttaaggaaactgcacatatcttggtatgtttctgatagtgcataattccagaaaatgtcttaagcattgcataattgttagaaacatgaaatctgcagccagcaagcatgagttccacatctgaccctactctttccagttgtgagaacttatttgtattttaaactactgaatttcaggatgcctctgtttattcctgtttctttattttttaagttgacagtatttgtacatattcatggggtacatagtgatatttcaatacatataacatatactgatcagatcagggttattagcacacccatcatctcaaacatttagcatttctttgtattgggaacattcaatatcctcctcctacctatttgaagttctataatattgttaagtatagtcatcctacagtgctatagaagctataacttatttctcctgtctagctgtaattttgtatcctttaacaaatctctccctatcttccccagcctctagtatcctttgttccattttttacttcttcctcatgttttaaagggaaatgattacagtatctatttcattaggttgctataaggaataaatggtttcatagctcttaaaatagtgcttgacaaaagtaggtactatgtgtagatttttattaaaaaaagtagatactatgtgttattattatgactaatcttctcccaaaaatatgtttggtaaatcatttcataaatttgtttattcttaatttattttgaattagaatcatttgtataacaagttggtatattgctgagcacatctgtaaagtaagacctgaatatggatttgataattgaagttgacactcatcatagagatttatgaaatattgtgcgcttgattgcagtaggacaacttactatggggaaggaatcttgtaagtatcttgcctggccagtatacatggaagttggtacacatggaagatataccatatgtatatatcccgatattgataatgttactttccaaaagtggaggcactgcaaatatgatgagaatgtgactagagcacgcacttgtttgttctttctgtccagcattaatttcccccttattccagtaatagtaactcaacaactctgctctttgtcatttcctggtgtttttttcttttcttttctttcttttttttttttttttttttttttgagactgagtttcactctgttgcccaggctggagtgcagtggcatgatcttggcttactgcaaactccgtctcctgggttcaagcgattctcctgcctcagcctccccagtagctgggattgcaggtgcccatcaccatgcccggctaattttttctattttttagtagagatggggtttcatcatgttggccaggctggtcttgatctcctggcctcaagcaatctgcctgcttcggcctcccagagtgctgggattacaggcatgagccaccgggacttgtctgtcgttcgttccttccttccttccttccttccttccttccttccttccttccttccttccttccttccttcctccctgtctgtctttctttctctttctttctttctttctttctttctttctttctttctttctttctttctttcttttctttctttctttctttcttcctctcctttctttccttccttccttccttccttccttccttccttccttccttccttcctttctctctctctctctctctctctctttctttctttgtcttgctctatctcccaggctggagtgcagtggtgtgatcatagctcactgcagcctcaaatgcctggtctcaagggatcctcctgccctgatctcccaaaatgctgggattacaagcaaaagcaaccttcccagctccaactccacttttcagaaatgcttctgtaccacaatgataaccctgactactcataggtttcaaatgaggactcttccgtgtttcaaggctacagcatgtggcttaggagaggccaatcaaagacggcattaccctggacagagtaattacttcaggatgggcatgtgacccaccaggtgtcagtgagatgcaatgagtttttcggagtctttcttcccactgaattgaggtctggaaggttgggaggctagagctgctacagcatctagctgtagggaagctacggctaagagaagaatctttaggaaacttatcactatgaaagtcagaacaaaaggatacagcataactatgagctggtaacatcagctgagctcttgaatcatcatatgcctaagactagccctggacaaaccatgaaccaataaactcctgtctttatttattttttacttcaattagtttgagacatctttttctcttacaatcaaaagttatctgctaaagtgactaaaatattattttgggctacatcttccccttgctcatttccaacaaacacattttcttcttttctccaaatcctttattttagattcagtgggtacctgtgcaggtttgttatgatggtatattgcatgatgccaaagtttgagggcacgattgaacccaccacccaggtagcaagcatagtacccaataggtagtttttcaacacttgcttcccccaccctatacccacttatagtccacggtgtctcttgttcccatgtttatgtccatgtgtacccaatgtttagctcccacttataagtgagaagatgtggtattttgttttctgtttttgcccaacaaatacattttccaatgaaaatgatgaagccagaaagtatgaaatacattgatttaacaattagaactgttctaattataattgataccggtgcctgttttctttttatgattgagtaatgatcacagatttttgctatcagattttgagtttgaatcctgcctgtatgatcttaggagacttttcctaatctcagtgtatgtccttacttcagtttgcaaataaggataatgaaagcacttatccaatagggttgtgtggaggatgaaataatacagggcaaatgtcttagccaagtgactggcacttagtaagtcctcaaatcttcactatgatattaattgaaagcctagcattcacaatctcactggtttatcagttcttttttctggttgctttttagtgacttaaatcagagataaataagattggtgtctcactgggttaatattttttctggagagagttaacttgtgtggcacaggccatctctttattgaattagcaaagaactacattggatttaagattatctggggctgaggctaatatcaaatcctactctatgtttgtagttccttggctacaagcctacatacggtaattgctgtttaatatgaatttttatttttaacccttacatatagtaagggttaattgctatttaatatgagtttttatttttaacccttccctatttacgtcatgctttgcttaaggaccaagatatattctgagaaatgtgtcattaggtgatttttgtcattgtgtgtacctcatagagtgtacgtaaaacctagatggtagagcctattacacaactaggttacatggtatagcctattgttcctaggctacaaacctatactggatgttactgtactgaatactacaggcaattgtaatgcaatggtatttgtgtatctaaacacgtctaaacatagacaaggtacagtaaaaaatatggtattataatcttatgcgaccactgtcatatatgtgatctgtcattgaccaaaaatgccattaagcagtgcactactgtactttctctttactttaaatttgaattctttatatgggttgaatgactttctgacatagcaaataaaaagcatgaggagaagcattatctgttaacaaaattaacacttaaaatcaacaaagttttaatgtttcgttccaagaaaagcctgtggaagatcagttccacaactgagagctttgggctgcttcagacatatgtctgtgtgtacgctgtgaaggtgtttctcttcacagttccccgccctctagtggtagttacaataatgccattttgtagtccctgtacaggaaatgcctcttcttacttcagttaccagaatccttttacaggaagttaggtgtggtctttgaaggagaattaaaaaaaaaaaaaaaaaaaaaaaaaaaagatttttttttttttaaagcatgatggaattttagctgcagtcttcttggtgccagcttatcaatcccaaactctgggtgtaaaagattctacaggggtaatgttttattattcttattatgcttattctctgtgatgcttctctacctttacagtagtagaatccttggggaaatctgcagagggaccactttcattttgaagctgctggctgcatgttttagcatgtctcttctattagagaatccaggcatggcagtttcctcccccagtgtgcaaggaccatcttcatgcctatgtctgtcgctaggcatgagggtctctaggaatgggtgaaaaaaatgagggatgttttggaggcactataatactggggagggcagtctgctagctggtagctgaaaggtcctggtttacttcaacattttttttaaataaaactgtgcagtagtttttgttattttaggtttccctctgttttatctggtgtatgctgcagaagtgaactgcataacacatttcactcttagaaaatgcatttcatatatttaaatgacaactctgactcctatagtatgggggtgaaatagattgattttttgaaaagatggaaaaaatagattaagtgtcatttaggagtcaagatgttgattgtattgtttcaaatagcatagaaactcctgccactggttcagaggtaacatttggaatgactgatgtgctcttttgagttatctactttagtctggtgaaatatgatttgaataccagtaaaaatctatttaggttattgcaaagactcatataataagagtttgcttgaaaagataaactatcgtaaacttattattttttctcaagtccaaattctgatatggacactaagactgtgatgctacgtttttatgaaatgggcataatttgaggaaattggctatctctacagtatttcctaaggtactgcaaatgtgttaatttaagaagcaattacactagctagcagcaggttgctaagccagggggtccgagctacagacctctgatgtggatgacttcctgcccggtttggcaggagctgggtcccttcctgtgcagcttccgagcagttccaaacacaaccaggcatcttctgctccttcccactccctttctttcaagcaggatctacctatgtttccatagcctggcattttaggatttccagagatttttacccagtgaattgacttggaataaactcttaaatgtgataaagtgagccaaagggcacgtgcaaagacttggagagatatgtgcaagatcctcagctcaggttctacaatttaatatgatgtttcatctcttgttttggatctctgctattttttcagaaagaatgctgaaaaagatggctgccaaaatattcacacaagtgaaacagcaggcacaaaccagtatcctccatttctgagctctgaattgcatattttcccacaagtagcacaatcacttaaaacattttgggagtgggagattagattacctcatagacacctactgaatgtgagagatagatctccatgtgagcaaatggatgcacatatgagattccctgaataccaaatacagctttctttgaaaatattatagctatctgagtttctatgctgtatctcagtgctcagtgtcatgtaactgacacaatcaccttttattctaatggtcattgctttttttccctccctgtttctgtagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaagtgagttcttagtcaagttgccttcactgcctatttactaattggttctgggctagtcccagggatgatggtgaagaaggctggcctccttccctctgtctaaagtatcactaagatgctggatgggcctgaccgtgtaatggaccaatgatcctagaagtcttttggaagcactcatttgaacctgcatttgtgagacaggcagagaactggtgaggcatcctccagcgcgggaattaaggaaggacaaaagcctattcaccttcttgaatacaaattatatgcttaaaccagtgtaaattgaccctgattccctaataatgttgagaagcaaaaactgtaaactaggagtctatttaaattttattttttatatttgcaggagtagtatctaaattcctctttatagtctctagctctccataagtcactttgatcttcagtgggtttaattattcctttataccatactttctcctttctattgctctccacagaaggaataatagcaggtgacttgtaggtgccaaataagattctgagcaaagaacacacctggaaaaccttgaagttctcatgagaaaattttctaaccaaaaaaaaaaatcaaagcctcaattttgtgctttatgtgaattataaatgcggttttaaaatacttacattaaaacttgataaagttgctaagaattcctatggcattgatcacaaattttcttaataatcctcatgtcatttatcaaatttaggaaagtttatagtgctcagaaaaaaaaagcatctatcttcatgtcatatgatggtaattattatgttatacactattttacagggcaatatttataaataatggttttacttttctcttaaaatattcttaatatatattctaagttttattttatgtgttgtgttttctttttcagacgtttatagtattgaataaagggaaagcaatctctcgattcagtgccacccctgccctttacattttaactcccttcaaccctattagaaaattagctattaagattttggtacattcatatcctttttcaaatcgtcacttaatatgattttcttctttgaccaagttattgagctacacattttccaaaatatctgtggttggcaatgttatgtgttctttctttttctttccttttactcaatcgttagcatgttgcaaaatgagatcacaggtaagtgaattactttcccccgtcttctaagtgtttcttctctacccaactcactattacttctttcttctcttttcttctcccttacgaattgcttgccacatcccaagcctttctcattaattttgaccatgttaccaggctttcctcctgtaagtcttcaatttacaatgttaggtaagggagtaaactccatgagctaattttctttactgcttttacatttggaaaataaatatacataatctgaattacaattttgtatgtttttggtctgaattttatgactttcttctattttagcatttaaaagctttgagttagtaagcgtttacaattgtgtctgtaggtataacaccctttcaaatacttttccaaatttgtttcgcaacagccttcttattgatcttttgctttctattcttttcctttctttttctttttatcacttgttcctatgttttattgaagtcacaagtcttgctacaattatccctctccaaaggattaatgtctatctatccatatacattctcattttattttttatactccttattgaagcacctgctttccaaaaatgagattgatgacatcttggtgggagatggcaatttgattgattccttgaaattaaatagagtagttggaaatgagagattttattctaggccagaaacaagtcttgttgacagccagtcttgggaatgccaatgaagcaaaggcttggaagactgaagctgtgtggggcaggggcatttacacgaagaacacagaagtcatgggaggaggagtgatatgcttcaggaatcagaggtaaggcaggggaactgaaattaagcaaatcctcagattaggacagcatgttatttcttcttcagaaagaatcgttgcttggaattccatgatgtggttagcccagggcctggtattaaggctttcagtataaatattctccacctttagcaggcctagaaaatatttgaattagataaggtatggaactaaattaagtagggaattcaggaaatgggataagcctggtacagggtacttatgtcatttctgggtggaggggatgtaaagcatgtccctagacttgcctcccagtatggcaaatgttgtctttagaagtgtaacattctgtaaagtctccttttaacctctaggttgttcctcttccccagtttaggtggatatcaacatcttttatttgatgtttatgtttcatgttttaagatttcctagtttcttggcattaccttaagcaataatgttttcttacctctctctgttttccaaataagagaacccagtagcatgtggggaaaaagatgtctttgagttagcattagaaataaataataaagttggaatttatatttgggtctcatgattataaattatgatctattattatgtttcaagcatttgtaatctgtgcagtgaataaatctctgcataaactattcattatattttaaaataattgtatgttccttatgcaaacgtaatttatatataaaattacgtggaaaattctagcctagaactagacttctgttcctagtagacattgggaaaatattcattaaataaataagtgactagtaagtcagagattagagaatcagatacaaaaaaagtgaaaaaataagtttgaatggatcagaaaaaatctttcttgtcgtgcatctgaatgatgagatggagttaagaaaacccaatatatttgttttttacaaaagcagatttttgttttaaaacttttgtaatagaccatggaaaatctcatgaaaactattgtccccacttgaaaaaaaaaatcctaggagattatgaatccccatttaaaactccctggaaaagagactcctggtggtagagggtaagggcagtttaagaaattctgatcagagaatatgagtactaaggacacagtttgtgccaggacctctctagatatccagatacaacttgaatctgtgggcttgtatttgcttcctgggggaaagaactcaccctccacaggctgaagtcattgggaggcctgaggagatgcaggttgaaatgtgaagccagccaggcaaatctattaaggtatgccaagttgagctgttgattctctgagaagtttacagatggcttagagtcacaaatttattccaatgtagaaaattagattttaaaaagtctctaatttcctgacttaaagtgttatatttcagatgtctcaccttggagcagagatataacaaaaggcagtgaggctaatagtctaagatacatgaatccttccatgttttggtgatgctggtgcaattgatcaaatagcccagtaaagttagaggtatatagatgctgtagttagtaactgattttcacaataattttgtcctttattcctcttgttgcaaaccctagacttaaatcctgattttctgacttcaagtacagtgtcttttactgtaagttaaaaatgcttggagagatggtcatggttgtttggccacagttgggaggtcattgtatatttattaccactagtttataaaccaacaaggagccattcatgttaaataagtttttattttaaacttggactaatacctctatttcaaacaaaaaccttgacttgtttctcaaagagctgttatctattaggagctattgtgtatcaaattagcttttttaaaaatttattttggctgaatgagaaattatgcttgtgatatttttaccagggtgcattctgaaaactgaaaattcttttgatgtgcctagtgtcttatttgatatttaaataaaacatgatttattttctagataacaaacaagttaaaaataatctatgttcctaaagttccctaccaagcttttaaatgtgtttcctgtcagcttttattattttaagttaatatatgcacactcctctaatttattttgcatttgttactcatttgttcatttgcaagtacttactgagtatctaccatgtggtagatattcttgtaagcattgggatgcaacattgaacaaagtgaagttcctactctcatgtagttacattcatgtgagtgtgtgtgtgtgtttggaagaagaaagacaataaacaaatacgtcgattgggagctagtgataagtgttactaagaaatataaattagtgtcaaagggaggagtgacaaggtgttgttttagattgtatggccagtaaaatcctttctgaaaaggtaccagttgagcagagatccgaaggaagcaaaagagtgagatatgggaatctagggataaagtcagttcaaggagaacagcaagtatgaaggtaaagtctgaaggtggtggtgcaactagtatgtttaacaatcagcaaggagacctgagtggctggagcagagtgggaaaggcaggaagcgagaggatgacatcagtgggagtgaaggtcaggggctaaagttgtaggcgaggtgcagtgggtcattgtgaggacaccacatttactctgaatgagactccaggagggttttcagtagcaggatatcatgacttgactcacatatttaaaagatcactctggctgcttcatggagaatagactgcataaggggaaagagtggaagcaaggagactgggaccgattgtcattatgaaggcaagagagcatggtggcttggagtatggtggaaacaatgaggatggtaaaatgtcatcaaattttgaggtattttgcagaagagctgacaggatttgctgagcaattggttgtggtgtataggaggaaggcagggactaaggatgattccaagcatttagtctggtcaagaaagaaaaatggagttgtgttgactgagcttggggcaacttgagcaaaccaatttggtgggtaagatcaagatcttggttttgaacatgttatgtttgagacacctattagacatcattggaggagttgaggagttaggtggctgtgcaaatctggagttcagaaaagggctgggctggaggtgttcaactttgggagctgtcagtgtacagctggtatttaaagtcatgacattggactaggctgccaaagagctgagaccctccctccaaatcacactagtaatgctgaactacctatcatttgaaaatggtaggaaaatggaaaacataggttttggtatcagaaaacgtagattcaaaccctatctctaaaatttactttttagctatatgatcttagtccaagttactccaattctttcgaatctcagtttctctatctgtaaaattataatcacagcttagacattaataatgataaaatgtatgacaagtatctagcaccagatcccatgctagtacttagtaggtactcaataaaggatatctatgacagtaatagctaaaattctagcagcaactgctgtaagattagcaaaaaggaaactctcatattccttaaggaattgcacaaagaactttatagaaatccctactctgactctgcaaacaaaatctttatatagcaccagagtttagacctgcaactgacccaaacaatgtggtcagttctgtctcattttgtagatgagttcactgaaacccagagatatttagttttttctaaggctacattttctatcagtggcagagctaaaacttcagaccaggttttttgattcttggctctttgcattttgcatccaatagaaaacaaatgatttttaaaccctcggatttaatatacttggggcattgccagtgttcttgttttatgcatttcaaaggtgcttcttagttgctccaacttactgattcattaaatagtgtccatactgagatataaaatatcatggttttccatgaaaagaaatatacaggtttatatgaaagcagatgacacaacaatttctctttcttttgttttcaatgctcatatgttatcatttagttatctactggcaaataggagtttgttcatattaaaattaaacaatccaatatttaacactgtatatgtgacatttactcgatttttctgctggctcagaaatatgcactggtatgcagaaaaagacctattctattctacttcaaattatccatttttacattagaaaacctctaacatcaggctatcttctacttctagtttatatataggttaaaaactcctctgcaacttctctggatattatacattattacaaagtctctgaacagagcataatgtcttttccttcctatagaataacaaagaaatgtcctataattttatactctataaatgagttattaatggtaagaaaccaataattattatcttagtggataatgactgtatactgtaagaaaagtattatccacatttatataagaaaactgagcctcaaagaattaaacaaattgctgaagcccacatggctggtaagggatgtatctgaccatggttcattgctctaaatctcatggtgcttcatcctcgctccacggagacaggggtgggtgtgccagtgttatgatgatccaggctccatgtcaagggctacttaaacaattttcactaaaaacttgaagaagtgtttcttcataatatacacaaaggaaatattttacatttgccaactcgcaggttagtatcaatcaacaggtttacccactgttatgtatacctggcataaagaaattaatagattaaaaaacatctttgtcccctgatattataaaaggtttatctgcctctattttattttacattgaaaagttcttaaagcaatattgttccaggatacagtgttcttttgaaaaatgtactctatgacttggattacacatttaaaaaataatataggatgtatgcattttgctactagtttgagccttttgaaatctgctttgacgtggggtttctatacttttttgatgcatggcatcaccaatgcaaaatccatacctacattaaatacttttgtatttgagtttttgttatttgagtttttttttttttttttttttttgagacgggttctcgctctgtcgccctggctggagtgcagcagcgcaatctcggctcactgcaagctccgccttccgggttcacgccattctcctgcctcagcctccggagtagctgggactacaggcgcccgccaccacgcccggctgattttttgtaattttagtagagacggtatttcaccgtgttagccagggtggtctcgatctcctgacctcgtgatccgcccgcctcggcctcccaaagtgctgggattacaggcgtgagccaccgcgcctggccatatttgagtatttttaagatcatctgaaactatttcagtcactcaccagaatccaggaatttgtaaagtatgtgactgatgaaataaattaacaatgatttagaaacttagtgaattttaagcctttctatttagagatacctatcaaaccacaagcgtaaaaacttgaccctagttatctactatttttctattaaaagcaaaattgttctttttatgtatcagaagttttaacttaagtgtatacttttattaaaatgatagccatgaaataaggaaaatgcctgttttcgacttattatcagtgactaattagaaaataattatttctcttgttaatgttgaaatatatattttacttttttatatataactaaattataccactataaagagtaagtttttaagtgtcataaaaccattgccgagtccataatgcagcataattgcataaggctgttaatttccaccttatatttttcttatatttttaccctcaaaaaatgtagaaacttgtgtaaacaatatgtatatatattttagacagagtctcactctgtcacccaggctggagtgcaatggcgtgatcttggctcactgctacctctgcctcctgggttcaagtgattcccctgccttagcctcctgattagctgggattacaggcatccgtcacgcctggctaatttttgtatttttagtagagacagagtttcaccattttacccgggctggtctcaaactcctaacctcaagtgatctgcctgcctcagcctcctgaaatgctgagattataggcgagagccatggcacctggccaacaatatatttgaagacaaactttatgctgtatttttaaataatttatcagaaattgtttttaaaaactccatttagtaacaaatgaattgcaaaattaatttcattagtcaactgacactgtgaaatagcaaggctataatggtgaataatatagacatgattcctgtcctcatgacgctcagagagtagttgagaagatcatcattaaaatttgtcattagaggaataatataagggctgctggggtatataactggtaataggtcaatctgagtactaaagaaaaagagaggtgacatttccaagaccctaaagtcagaaacagcatataaaacattcataacatttgacaacctaaaataattacagtattatccaaatggggataatgcaatgaagagaaaagaaaatgaaactggagaagtagacagggatcagacctcctagcgtcttgactctgtgttaagacatttgatcatcatcctaagagtaatagaaagctaccaaaatgatgcatattacatttacaatggtcgtgttagcacagtatgcagaatggattaaatggagccaaacatgaatttggaaacatcagtttagaggagactgcaataatctagatggactattagatttgatgctagtcttgacagacacttggaccatgcagtgatatggggatggaaaaaagtaactgaatccagagatagcaggcagaattgacaatatttgatggttaattagatatgaacgtttaaggggagacagaaatctaagatttctcataggtctctggctatattatgcacattttataagacacagagacgtcaaaggagtaagtaattagcaggaatggaggggtagattaaaagatacttttcaaaagttcagttttagaattcaaaatttgaagtgttgataagatatgtaagtacagatgtcctatggacaatcaagtatgtggaattcagaagagcggtctcacttggagagaagtatctgagaatggtgggtatataatggttatgtttgttgagcaatgtttgttgatggactacactaggatgaggagagtagaagagaggtagatggcttacataccttatgtctttcttttcaaaaagaaaaatgccacatttcaaagaatacagagaaattggtgccctgaggcatgaagaagccagggaattggaacctcctgaaagcagagggaagataacttaatgctaaggggaggaaccatccttgttgaatgctgcttagaaagcatgtcaaatataatctcaaattatccttttgtttttagtgacaaaacgtgaagatgttgccatctttagaaagaaaagctggtaggctgaatatatgatagatatataagaaaaggaaagataagcagctctttcaaaaagtttggccatgatatggaaaagggagataaggctgtagtagttaaggagggttgtgagtcataggagagaaatatcctttcccctatgccaggacaagggagacgtaagcaagtttgtgttgctgggaaaaagccagtaaggtgggagccattaaggataagaaaagagagagataagagattgctgaagtcttctggaatggggaaggtgtccagaataccggtggagggattggaaacctccccactgtaacaggaaggaggaaagaattggtctcaatgtggaaaagtttgttgatttgggggtgggaagtggaggcggggcattgtgatgctgtctcttctctgtaaagtagaaaataagttttcagcttgaaatggagccggaagaaagaagagggttggaagctggaggaaagtggagaatatttgaaatttttctttgcagagagtgggagatggagcctagtaggaaaatacaggactgtgttgaggaccactgaggtttgtgaccataaatttagaatggtgccaatctgccacggggtgttatttttccccaatagggctcagcagaccaacaagcacaggggaccctctagttttatataccaatagcaagtcattctttatttaatttagttttttgtttgttatagcaataaagaaaaattgtgtttctttgaaatggtattttgtgtgtgtgtgtgtgtgtgtgtgtgtgtgtgtgtgtgtgtgtgtgtgttctctagattatagtgccctcacgtggctgatgcacatcatttacttatgagtgttttcatatggatgaaaaaactgagaattaagcatgggccttacagcacagctactaaaattaaaaaataataattattattattgttttgactaaaaccagtactagatgcaaatgaactttctttctagatcaacacaacattgtccagttgtaatagtgttgatatttcattatgtgtaagtaatgtgatcatttatagtaaaaacattaggagtgagaaaagatatgaagagcacgtatttcctctctggaatttctataattgtgtccagattcacaatgataaagagtgccactttacataatggcaactaaatctttattatgctttttattaaatatgaaagtcattactattatctgatactgaatattttcttaaatagttgttttggtttttgtcttttgctgttttttaatgtcaaggaaagtgaagggcattggctatacctgcaaagacaaagtgggatagggtgaaaccaacccaatatttgtaataaactgtgttctgtatgatccaggaagcaattcattgagcatctattacgcactagggccattaagttgaaggagacttacatattttaacaaatttgatcttcatagcaatcctgttacatgattactttttcttacttttataaccaagtcaattgagattcagggaacttaataagtaattttgccttagttacaaaccccagaaatgccagtgctaacacctgccatcttctctcatagttcaggattttatgagcaattacagtatattataccctctgtttagaaaggaccttattataagacattccaccagggtaacttttagaatgatgttataatacatttaattaattacttgaattgtcttgttgaatttttgccagggtttacatatgtgctgaacttgcagttttaatgttcagttgagtctgtcgttaagaaaatttaagttgataaattattcactgatgaactactttctttgcatttaatctttttaattgctaaaggtacctaaatagcctcaaaatagttgatggcttggcctgaagacaagatctaaatatgaggttgctgagttatagaaatggcaaaaaaaagggtcaataatagaataataagcaacaaaataatagtaagcactaaagttttaaacttcatggtggtgaaggcatggtagtgcataaaagtaagatttttccattgaactttgtcttccttgacgatattctactttattcaatatgctcattatgtgcacgattcttaccaactgtgtatttatgaccatgagtaaccctccagactggacaaagaatgtggagtaagtataaatatttttcaatattgacctccctttatgtttcatattgtgcttttaacaccttgagacctcctcaatttctttaacaaatcatgctagctactgttaaccagaccctgattcaaattcatttctgtcactaaatgtcttctaggacaaagcttgtagtgggctcacttagttgtgtaaattactgcagtagtttgactgctattatctgcagccctttatcttctttgtgagtcttatgttcttttgaagatcaccagtgatttactaatatctactgataaaaagtatacctagtttttatgttccttttttaatgactaccacagttctgtgttactagtatatgtttgatggcttttaatggtgcatattttatgaaatacaaatgcttcactcatttttgtattaatacctatttgctcaaatcggactgaatgccagtgtatttcagattatgtcttcatatagagccacattatttggatcctttaaattaattaatgtggaaaatgcaatatacatttatttacagtcaatgagaatgtcttttggaatttaatgtttcttttttgacttaagccccacctaaactctatatcgtagggggaccaacctggaagtgtctaatttttgtttgctgtttatgtcatctttaagatatgtacttgtaaattaaccactagatttttaatgtgagcttggctattttctctcaggtatacctttacaggaatttatacttttgaatcacttattaaaatacttgcaaggggcttttgtttagaagatttcacatttttacgggatccatggaattggttggatttcacagtcattacttttgcgtaagtatcttaatacattttctatcctggaagagtaaatcactggtgggagcctatactatattttccttggtggcttgccttgacagaccaagcatttttcttagtaatcatagttttcttccaatcaaattatccagtttggagaaattaggaactatcatagtaaattacatggctttggtttcaattagcactgtaaagtaataaagtttcccaaataacagagattatgattgatgacaatgccattttcctcttaattgggaaagctgatggcgacactcatgaaattaaaaaggtcttgatgaaagaccaaggaagacgtagatttccctaaattctgaataactctgatttaattctacaggtatgtaacagaatttgtaaacctaggcaatgtttcagctcttcgaactttcagagtcttgagagctttgaaaactatttctgtaattccaggtaagaagaaaatggtataaggtggtaggccccttatatctccaactgtttcttgtgttctgtcattgtgtttgtgtgtgaaccccctattacagatatgtgacagagtttgtggacctgggcaatgtctcagcgttgagaacattcagagttctccgagcattgaaaacaatttcagtcattccaggtgagagctaggttaaacaccgaggctgactttagctacagtggtgctacaatcacagcttttgtgcagaagccttgttgctagttgcatattgcaaataaatatgtaaaaaagcaagaattggtacatcattttttggatggatttgattctttgctttttactcgttgctttctttaaaactattctaaatcagcctttgagtttaacaagtgttgcatgaggcatttgcagtaacaggctacatggtttgcatcctataacatcaagctttccgcatagaagctagactaagagacattcagactgatgcaaatttgacagtttaggcctaaaactggcaatcttttaagctgcagataaatgaaagagcaagggatagcatgagtgctgcatggggctcagatttcagatgtcttcctttttttaacccatactcaagcttgcagaattcacaaatatataacctcataattcatcgacttcaagatttcttactactctattcacatagacttttctaaaaccaataaggggttagggagtaagacatctgcaaataaaagcaaaatatttacacaaggttgatgtttaagcatgaataacaaaatcattcttttgctctaaagagtgtttggaaatacacatttggttcatttccattcacagttttctaatgaacatacaagttctgctttcattcattttcaccagctagcaggcttttcatgaaaatgttattcaatcacaaacattaaactaatattgttggcattctgcatgacatttttattttccaggacaagctcatgatatttttgccggtaaaatagctgttgagtagtatatttaaattcccccttctgattttgtttgtaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtaagatatactctataaaccattaagttgtttagttctctaaatattaaatattatatataatggaaattatctcaatttagatgtgaatcaagtgacttagactaatttaagatgatttaatacatataaaagagatatcaaatgataccttattctatttttcttatctgtccattgatatagtaaaagttctcatttgaaaatgtgttgtcttatactcatgttgaaagtaatttcatattatgccatattaaaaaatgtttatttggtagacattaatcaggtttttcagtcattttaataaataagtcagtagtttgaactattcagtgtattccactgaaatgtgttaagaagactgaggggaaataatttggccctatttggttgatgcaacatatgtattgagtacatatgctatatctgaaaatagagaaaccatttatcaagatgaaataagaatttgtgtgctcctcagaaggttaagtaaccctgatttagccattcacttattcatattctaattagtccctttagtgtcatcattgtattgtagttaccagtttagtttgattatatttaaggtatgaacatcagaataagcttatgccatatacttcagcatgatttcttaacattgagcccagcccctctgtcatttttcatatgtgtgtgcatgtttgtatgtgaatataaaaatacgtatgtttgcatgtgtgtgcatgttttctgagatcatctttgcaacttactgaagttatatgtcatgccttaaaaataaaaactagatagctctccatagcttaaaaataaaaactagatatactcagacaacatatctctccaaagaaacaagtttattttcttcatttgaaaggcagaaatcaagcaaaaatttcaaacaaaacacttatttacagtatcataagagggaataaatacctaatcccacttctcacaggaaattaagttaaaattggcgggaaaaaatgtctgaatctattttgagcctggggagaaaagtatatgtaaggtaaaatttatttgcatgaaaacacctagaaacaacaaggctttcttctttcttactttttgtgcccagcaatagactggcagctctttcttaatgtatcccatgcaatttgagcttatatttgcaatgaatgctgatataagaatgttatcatagtaattccttctgaacatttttctttttaacatagatttgctaaccatttgtataatcaaaaatgttatatattgatatttgttcaatattgtgaaaaatctctttagccatatatatttattagtttatccatctcattatgattgaaaacatttgtgagctttgccacctaaacagggtggctgaagtgttttacaggattttaatgattctttctattcctttctctttaaataggtcacttttattttttagaggggcaaaatgatgctctgctttgtggcaacagctcagatgcagggtaagtgatgcttcctactgagtttcagtccacactgctccatcagtgtcaataacctgccacctcccactcatccagtcccactcactcctcactcaaaaccctccataaattctacttcacggtgactctcagaatagccaggataagtgtagattctcacctctttcacacagtcatttactgcaattatttttctatgctaggtcacatctaatcttccaaattagttcaatgtaaaatagagaataaagcagtataatatgcatctgaagcttaatagaattcttaagcacatactttttataagtgtcatattttatatatactaatgtgttctccatagcttaaaatgtaagatctctgaaaataatgttaatatctgagacatggggagtatttagcatattttagcaaagtggttacaaacataaactggagagtctgcatagagtcagactttgactccatcatataatctcatttcttcttgccttcgtttccttatatgacaaatgggtataataatagggtttttgtgatgatgaagtggattaataaatgtatagctatttagatcgctcaataagtgcttgtaattgttattattgggatcatgcaaatgtttgctattaagaaacatggagctaaatcctaggaaaatttaaaaacacagttaattttctttatttagcaagattttagagccacacacaaaagtctaatgcactttctttggacgatgatactgtggacattagtagctaatacctgtagcaaaattcccagtgataataggctttccatttggctcctacgatcagtgctatgctgcctttatcttcagattccaatgataagtaaatcaattgattttcattccttgtttgtactgtactaaatgcgttacatacagtatcttcttcaatgtttgcaaatttgtgagacaggttctcttattagcccattctcacatgcgaggtgcctgaagattagcaagttaagtaacttgcccaagatcgttcagctcagaagtgtcaggcaagacattgaagccaggtctgcttgatcttcaaggtcctcctatgacatttttaccacacagtgtcattcactccttgcagcatgccccacctatccttttctcacttctttaccctgttcccacacttacacacatttctgcctcaagacatcctcagtgaaaatcaactttttccttacagacttttttaactgcccttaagtcccagaagatattaatcatgatatgattgcttttatatggagacataataaatataataatgacaattatgaatcacagaggaatccacaaagtagaccttatagattctgttattatataaatcagtccacttagtgctgagttaagtactgggtaaggtgagagaaatcggcttttttctagtgcctgtataaaacagacattggcatatattaaaacaggaaaaccaattagcagacttgccgttattgacttcctttctttcctctaacctaattatagccagtgtcctgaaggatacatctgtgtgaaggctggtagaaaccccaactatggctacacgagctttgacacctttagttgggcctttttgtccttatttcgtctcatgactcaagacttctgggaaaacctttatcaactggtgagaacagataaaatcatttttctgagaatcataaaacaccgaactcaagagaattgctgtagaatattttattacttagagtgtaagtttgtaacatcctatataaaatttattaaaatctctcttccattttgcagacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggtatagtgaacaagcatacggtcctttgtttttctttatctaaattctttaacctaaatgttgaggtcagtggcaaggtagttgacattagaaataggtcatatgtgtttggtaagtgctaggagcctgtttggttattaagaagttattactttattgcaatgatctctgtcaatagtgtcaatagtaatggcatcaaaaaatggataattataattgctttactgacatttttttctcccttgtgactccttgaggaaattaatgattaacaaaggcctcatgtactcaaacttgcagagtagataaacctacatgtcctcagttgaagtattttcttaggggaagaggaattcagttacacttgcttcttcattgcagtatcaccagaggtggtaagggtcagaaaaccagaatcaaactaagaaaattatttcattgagtctggaaaggcaaaggcttattcaatatttgttctcttttatataaagtgtacaaatgcaagtttgtgggttacatcagtaaatcactagtgtgtaaacatattaaaacattagcactctctgcctcctactctacaaatcctttaatttggacttgacaagccttcaaaataaggcaagaatttctctaattatatttgcttgacttaatggcattaactaatccaattgcctatttttgtcttttcatgtatggtgaatacaattcccttttattaccgagtattcctaaatatgtaataaaggtcaaagtatattgctgtaatagcaacaaaactactgttatactttacaagttcatgcagatgccatgatctaggattctcaaataaacactctgtattatgtctttgctgtgcatttcttagtgaaatacccaatttaaatcacggagaaaaatgtcattaaaataaaatacttgactgaattacatttaataattcagactagcactaaatttctttattgtgtgaaaatggaatcaaaggcaaatgtctaccaggtttaaataggaagtctttaattcccatattatttccttcttaaaatattgtttgaattatagaacatgttattatgatctttaagtgtcttgctcatattattagataattagatatcatagtgtgaggacagagcttgaaggttctcataaaagtcgtatgtatcatcttccatatgaatgcccattttactctttgattggtctaataacaatgtactgttttctaaaacacagaataaaatggagaattgtttttcaagattatcttcatgatattgaagctcaattaagcagtaacatgataattactttttaagtttatatgcaacttccacatactttgcgcccttctaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccaggtaaaaatattaaattacatgaattgtgttctcataaattttttaaaaaaatatgccagaatttaatggagagaaaaccgccttccacctggatggcacaatgctttcagagtagtgatgattatcaagtgttttggctatcacttcagagaatttgtgagttttgcaactttttggaatcccaggaaggaaattttagatccctctgggtttggaaaaatttgcggttttgaggttttcttaaagactgaaaaatcttggagaaattttccacatcaggaattatcagcagatggttcccatctcttcttaactattgtgcgtggatctagtgaactttgggttttctgagtgacaaattcccagaagtggaccagagactcttttaggccacctgcggggttgttcccataaggtgcaaacatcacttgccaagtgcattcttcatgcctttgtttcaaaggggactgaaacaaaatatctctaaaagtagccaaaactctcagataggcaggtactgagggagatttatgacacgaaataaaaagtggtgtttagttgtacttgattatctgtgtttcatgttaaacatgggacttgcatttgaagaatactgtgatttataaactgcaacaaatattcactggatgcctctgccttttgtactcatgcaagttgttgaaattttaaaatttagaatcttaattgtctttgaaattaccaagagaattcacaggaatacacagtacctcagaagacattttcaccaggagtgaaaccttaatacctatacagtaacaataacaattacaacaacaacattgataatggctaatatttatacactgtgttgttatttgcaatattaatgcattaagcctttcactgcaaccctaggtaagttctaatttagttaatatccccaatttttatatgtgaagagaagcagggggctgcattctttgttgagtacctattttatgcttggcattctttctacattctcataattaatgctaacagttctgtagaatagtattattttcattactataatgaaaaagctattttggatcagtaaagttaaatagttgcacaatgtcatatagcaatagaaaaagttattatgatctttgagtgtcttgttcatattagggttgttggtattcaaattttgcctggtactgaaaaccttaaagtttccactttatcaagttgcctatgaagaatgcctttaaaaactgataaggaaatttacaatataactttatttaaaatacacaatggcattatactttctcttttacctttttataatatagacaagctcacataacctcacatgtgatatatataaatttttttaggtcagccttattcatttcaaatccaaataacatcataagattgcatacttggggattaattcaaatttaacataggatctttaaatatcaaaatttacttggtctctttcattttgttgtcacaatcatgattccattagtagaaacattaatcaataaataggaatcctttaaaaggcaaaccccctgtttacagtattagtcattctgaaaaggaaggaagaaaaagaaagggagggagggaggggggagagagagagagaggaaaaaagggagcaaaggagggaggaagatagagtatttttgcctacatttttacctaagtttgtctgaatttttgcctgaagttgtctaagttttggccaaaatttgcctaaattttggcctagatttgaaacttcatatcaacttcatatcaaacacttaccacagagattctcttcaatttgccttatttctaattgaataaaactaattctaggcaaaatagtgaagcctgataaggctaggctctgtccttcctttttctgtacattttgttcatagatatgatattctcccagcagcctcttcttcatacctctacatacctccatttcccagctagttgggtattataagcaatcactgacttagaagacatggcatggctggctcatattgatacttgtttcttaagcagtctctatataaaaatagagttaaagactttattttgcttgataaagaaatagtcaaacaaatgtctaagaggatggagagggagacagaaaaagacagagggaaagggaaagaaagagaaagagagaggggggaaaggagaaaaggaagaagagaggagagacagaaaaccctgaaatcacaccaaccccacttggcaagccctgaaagtaatactgaaaatgtcaaaccagatagaagtacttaatcttggtatagcaatggagggcccatcgtgtctgttagatttttaagagtttgagaccccaaaatattaggaattattgttttgtgatgacatgattgtgttggtaaccatctctgtgtttgtattgaaaaactatacaatgcaagcctttactgcaagattataatttctttagtagagtaagtggaaatatgaattgtttctcagactctgatttgacttgttagtgtggtaaagaggggagaagaaagtcaagaatgtaatctctaaacaagtttcaagataatctggatttttttgaaacctttataaggtacaattgaccttaaatcattactttattatttatttgtgataagctaggagtttaggagttttgctttttaaagattggtttggtatggggaatatttcttactggccatcttttttgtgtgttacagcatttgattactatgcatttatgtaatgaatgtcagcaaaagaagttgatgctaacggatggggcacaatcatttctcatatagctgtcacatgtaaactacgtttttgtatagcttaattcatccatgatccttgagaaacatgcaaacttataacttattttcttccaacccttctatggctccagctgaatggggtactggcagttaaaatataaactcttactaaaagcgatagaaacattcttcattgcaaagcatgtattgtttgcctttcttttttagctaatgaggagcagtatgtcacacatcctgcaaatcccgtaactgttatttcctcatagctaattcgaagtcccttgttagaggagagaaaggagacacgaaaaaggatggatagtctaagaaaggctttaaaaaataactacttgtatggaaaatgataaaagaaaagaatgaatgttactaatgtagttaataggattaaaaagcatgggaacaacaagaggagagatgacttctgttgtgggagcagtaagtcttcttagaagtagttctaggccgggtgtggtggctcatgcctgtaatcccagcattttgggaggccgagacgggcagatcatgagatcaggagatgagaccatcctggctaacacggtgaaaccccatctctactaaaaaatacaaaaaattagccaggcgtggtggcaggtgcctgtagtcccagctgctcgggaggctgaggcaggagaatggtgtgaacctgggaggtggagcttgcagtgagccgagatcacgccactgcactccagcctgggtgacagagtgagactccgtctcaaaaaataaataaataaaaaaaaagaagtggttcttactgtaaataatgaatagaatcacataagatagtgtttaacatttacagacatttaatagaaactaacagatattattgagaaaaagtaattctttagctggaaagaaaataaaaagcatacttattggtcagtgtattactctgttttcatgctgctgataaagttatacccaagactgggcaatttggcaaaggaagaggtttaattggacttacagttccatgtggctggcaaagcctcacaatcatggcagaaagcaaagaggagcaagccacaccttacatggatggtggcaagcaaagagagagtgaaagccaagcaaaagaagtttctccccatataaccaccagatctcatgagacccattcagtaccatgagaacagtatggggaaaacccctaccatgatttaactatctctgaccaggtccctcccacaacagtgggaattatgggaaatataactcaagatgagatctgggtggggacacagagaaatcatgtcattccacccccggcccctcccaaatctcatgtcctcacatttcaaaatgaatcatgccttcccaacagtcccccaaagtcttaactcatttcagcattaattcaaaagtccacagtccaaacaaagcctcatcggagacaaggcaagtcctttccatctatgagcctgaaaaatcaaaagcaagttagttacttcctagatacaatagggatacagacattagctaaatacagccattccaaatgggagaaattggccaaaacaaaggggctacatgccccatgcaagttcaaaatccagcagggcagtcaaatcttaaagctcaaaaatgatctcctttgactccatgtctcacatccaggttacgctgatgcaagaggtgggttcccttggtcttcagcagctccacccctgtcactttgcagggtacagcttccctcctgactacttccatgggctggcattgaatgtctgtggcttttccaggtacacggttcaagatgttggtggatctattattcttgggtctggaggacagtggctctcttctcacagctccagcaggcagtgccccagtagggaccctgtgttggggctctgaccccacatttcccttcctcactgccttggcagaggttctccatgagagccctgcccctgcagcaaacttctgcctgtacatccaggtgtttctatacatcctctgaaatctaggcagatgttcccaaatcccagttattgacttctgtgcactgacaggctcaacaccatgtggaagctgccaaggcttgaggcttgcaccctctgaagccatgggcctagctctacatttgcccctttcagccatggctggagccgcagagatacagggcaccaagttcctaggctgcacacagcgtgggactctggacccggcacatgaaaccactttttcctcctaggcctccgagcctgtgacgggaggggctgctgcaaagatctctgacatgccctggagacattttctccattgtcttggggattaacattcagctcctcattacttatgcaaatttctacagcctgcttgaatttctcttcaggaaatgggattttcttttctgtcacattgtcaggctgcaaattttccaaacttttatgttctgcttcccttatgaaactgaatacctttagcagtacctaagtcaccacttgaatgctttgctgcttagaaatttcttctgccagatactctaaatcatctctcccaagttcaaagttccacaaatctctaggacagggccaaaatgccaccagtctctttgctaaaatataacaagagtcacctttgctccatttcccaacaagttcctcatctccatgagagaccactttagcctggaccttattgtccatattgccatcaggcttttggtcaaagccattcaataagtctctagaaagttccaaactttctcacattttcctgtgttcttccgagccctccaaactgttccatcctctgcctgttatccagttccaaagctgcttccacatttttgggtatcttttcagcagcgtcccactcctggtatcaatttactgtattaatctgttttcatgctgctgataaagacatacctgagactgggcaatttaccaaagaaagacatttaattggacttacagttccatgtggctggggaagcctcacaatcatggcagaaggcaaagaggagcaagtcacatcttacatggatggtgtcaggcaaagagagagtgagagccaagtgaaagggatttctccccataaaatcattagatctcatgagacttattcactaccatgagaacagtatggagaaaactgccactatgattcaactatttcccaccatgtccctcccccaacaatggaaattatgggagatacaactcaagatgagatctgggtggggacacagccaaaccatattagtcaggcatataaaaacctagatattagtaggtataaaataatggttttagttagttttgaacctttggagaggaaaagatcaaaccaataatacttaaatgatgaagttagtattctttccaataataattacataaatccaatgcaagctggctgaagtaaaaaagagaatgtattagatgatataaattatgtctgtgagtagctttaggcatggatggatccagaagctcaagacatgttaccatgaccatgtctttctccatatctgaatctaggttcctcccacatggtggcaagatgtcactgcagctccaaacttaaagccaatatttttagcagcctcaagtgaaaaagcaccatttcctcaacagttgtaaaagacagggatatctttcaattgaccaagcaggatttcatgaccatctttaaattacgtatcgaatacactgattggctaggcctaggacagtgcctggaacactgggagacccgagcctcaagtcctgctgcatccaggagttgaaattagtgtctcccagataacctggtctgagagttgaggattatttctcaaggctgaacagggtactgatttaaaaaaacaaaaaattaaatggttgtgatcagcctcttagtgaaaattaagtttttgtaaatattgccctcagatttcttgagacagagacaaaggggtgaaaattggggaataaatcatacagttatttcagcttgatttaatttattcatgaagaccatcataaaatatgcaaagggaagtggagaagctgccccgtgtactataattaaacatccctactagcaagattaattatatttcctccatggtaagatttgcatcagggtgtggtcactagcgagctcttactggctacatttttgacctcagaggatctaaaggtagatttgtgtttaattgttttccattgggttgttaactgaaattaacttctaaagaagggtctatcaacagtatcagttctagatgcccgtaacaggacaaaacattatggggacacttctgactatgttgaggtgtgggtaaagtaggagaaaagagagcagaagatggaaaatggaggaaggagaaaaagcgagagtgaaatagaaaaggtgaaccttgtagaaagtgccaaaatgccaccagcagtcatcagaggggtgctttcttccacatgtccaatgacttatccttgagtaagtcaatgactatgacacaatgaatcaaattctgtttttcagaatgccagctcttaactctcttcatctcatttttgtttcttctcttgttattcatagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagaggtgaggccaattaaaattgcagctgatgtgaagagagttgtgactggtgcaggcaggagtgtttttccatttccacatctaagaatttgttgagtttgttgcccaaaggctgggagtttgttcaatcaagctgttaactgtcttgtgaaactgttctattcagacttttctacaaagtaattaaaaacctaggttggctgtcagagaatataattagaagtaatctttcatcattattactatggtatgaaactcgccaaaaagcaaagcaacaatttatcaagcataatgtttgattaatatagttaaattaaatccaaggaaattaatgctcactaattaaataaatacttaaggattttgtgattgttgttcatttaaaaggagatttgaatacttccacttgcagtagatactattactaaatagatttaaatcccatagtacaacattgcctctctttgcaggtcagagtgttgtaacctttttagcatccactctaatgatctcaaccattgtaaatttatacatgaagagccattcaaaaagtacctggtttggaatcatgggctgtcatttttagagcagattccaatttttatattactgtcataaactcttattgtaaacaaagtggcccaaaaccaatcacatggaaaaggatttcagctacatactagacacttacagggctatattattgaaatttacttcataaaccataagaagcttttaatgttggtattaaataaaattccattagctatcaagacatattttggcaatgtcacttgattgtattttatagcattcaaaatgtcttcttatgatttttttttcacatagctccatttattatcattgaacaagctctttgagccacattaaaatgatacggagttcgttttcagttacctaatggaggagcttcttatcttggattataaaatagccattatcttcttcacattttttgcatggcctctccccacctccttctaccagagaagtgtccaggtatcctgcagtcaggttgaaccatgagaaaagtagaactttatagtggaggaaccaggaagaatgaagagaggacatcagctcttcttaaaaaatgatcatagataaccatgtaccagacactgtccagaacactgtacatgtgttaagaatcatttaagcatcataacaaccctttttgatagttagtaacattatcccaattttacagaggaggaaactgaggcttgtgcgtggtggagctaagatttgaccccaggtatgctggttactgaacctacattctatcaacagtgaaatattgcctcccactgagttatttttaatttctttaaatcaaaaagaagagatggttaaggaaataaacacataaacactttcattttaaccaatgtttctcaaaatatacttcactttcatactacttacatcagaatctcatgggaggcttcttaaaactagagattcctgtgcctacccagaccttttcagaccaaaccactgaggagaacaaggtctgggaatcttcttccttaacaagcatcccacataattcttatacataataaagtatgtttatcactgatcttgataaatgttaattgggtaaacaaaagcaaatctacaattaccatgcaggaatacagacagactgtcagtctgtcagaaattatttagcatttatcaataattatcataaatctcctgtcctatcagagatgatgggacaaatcgctgaaggcaaagttggggccagcttgaagcaaagctttgtgtggtccctttatttcctgcttcctcaacttcattctttaatcttacaatcttaagtgctttgaggcagggcactgtactattgcaaagttgagctgaaggtgcaaacaaatgaagtaggcttttggagaatgcagaggtgaaatgacaatagaaaataaatagctatgggcaaatgacacccttgaaagcacatcatttcctgtactttacacataaattcaatcgagtaatgtcattagcagttttggaatctatttgaaaattagacaaatctaggtttgtacatgtgcttctgtgtagaacagaagggactagatgatcttcatgtgactattttttttttccttaaaactttgcctctttctgacaagctgaaatattttaaattctaagaggcaccctttggattaaaagacttttatttttagagataggttatttcttttcttactaattttacttgtttttttaccttaaaattaattttagaatgacctatatgaatagttatcaccattagtgacaatcatatgcaatgagtggaaattttggttttgaatatgtatgcattaaaataattcaacttacaaaagataaaatactgctaattgttcacatcataataggatgtgaccaaaataaataatattttgatcatattattatattttgatcatattgttcttttagaaatagggaaagtcctcaaaggaatgaaactttttaatttattattaacactcagacctgcatttgaaattctttagctttacctttttttttcctgtgataattgacatcattgtttgatctcctgaagtaggaataaatttccacccatgttgaaatcctgatgagtttattctggagtaggagattatcagatcattgtatcattactaaaaatcacagtcccccacattggtattatctccttaaattatagtctcagtgccaagggtggattgttttgtggattaagttgtttttcaaatataggacaaagttatagactagttctaaaatttagttttgtaattaggaatgttgggaaatattacctgtgtctaatgaatgaaggcattttgcaactggaattcacattttaggggaactgttactgatgcatatgaaggagactttcaaacctttttgttcatatattaaactacctgaatatatgtctataaagatctaaaaactcaacctgggtgaaaattaagaaacaatatgttttggtctgaagtcctaagtgggattggctgaaatgctaaaaggttatctgtccagtagtggacctggtccctccagcccaaatccctgggatagaggcataggaaagcccaccttgacaaacccagggctccccaaaagctgaaaatctgacagacttttaaacaacccccaaagaattatcattccaacaatatcttagtgagctttttacatctgagaaagcatggtgtatatttagttaaataacacctgttgtaggaatgctttgggctttgctgctttcaaaaatagtggttatttcatctgaaattctacttctagggcacaactactgaaacagaaataagaaagagacggtccagttcttatcatgtttccatggatttattggaagatcctacatcaaggcaaagagcaatgagtatagccagtattttgaccaacaccatggaaggtatgttaaaagtcctgcgtcacagttacttggtgctttggtaatgatgaaaaaacacttcataaatttcaataaaatacttcctgacttgatattgtatcattattacacattttactaaataacagtaaaatccgtgcataactcatggattctattatcttccacagattttttttttttatatttagcctccagaaagctgctgcaaatgtaaggtatattttgaacaccactttcatacattaaattctaaacattgaaacttgtgtgcatgacgttgaaaagagtgtaatgataaatgcttatacttatgatgatgctaagccatttggattatattaactgcttgagacacaagttataaaatcctatgacttaaccagaaatataaattaaaaatgtgaattagggtttgatattaacttccttgaagcaaagtgtttaaaattttgtagtcctacttttgcctttctctgaccagattcttacaatatatcagctttctctttagttgcagattttatctgaatagttaacataatgtgtagcagtctggatctcagaatgccaaaataaagactttggggacagcttaatctgtgatcaatttctggctctgccatatgttaaatgtgttaatttgtgactttgaatttcagtctcctcatcagtaaaatgtggatgatgatgtttaggcataaggttgttgaatggattaaataagccttcttagataaaacactgatgtatttggcatgcagaagacagttaataaatattatcaatattagttgttttgttgttgttatttttgttaattcacatgtttttgcctttccatactgtaagtgaattcaaacaactgtcaacttcaactacttggaaaatattttcatgtaaaatgtattctatcccccttccttgccctcctattccctcctctccctatctctttacaaaccttctcccttgtaccccttcccaggtatgtgtgtgagtgtgagtgtgtgtagatgtgtcaagggagaagagaaaaggagaatgaaagcaaaagagagcaagcatacacgtccctttcttattgataattagattttctcttgagattggatagattcctggaataattcttttcctgtctgtatgcaaagatcccataatattattaataccaatacgaaaagcctgaaaatcacagccagaaaaaattcacagtgtagacgactgtgtacatcacagacaagtcagtattacaaaacccaattttcatagtgtcctatttcagtatcctaatgcaattcactgatttcaattgaatattaaactctagtacgttcttccccaacctcgcctgcgttagcttgcactccctcttccccccagctgccagtagcttgctcctccctgtccctccaggtaaatcttttgaagattgtctggccttccgctccttgccatagcaaaaccactgagaggaagctgccagtggttctgctaccgatgtcagcagcatgtctgctccctaaagcaggaagtagagaaggagacagggtaagtctaaatcaacagtcatgctttgcacttctgatagcattaagtttgagctaaataagacattacttaaaaaacctcaaatatccacaagattggacttgccaactaattaagatttggagttcaaaataaatgcacccacacctttctccatggaactatgtgacatggggttgcttaggatggaaaggatgttctaggaataagtgcaatctaggaagctgaagactgagagtgttttcgttttattatctgcagagcttttgacttgtgtatttgtgagaaataatggccaagtttttattctgtttttaatcagttatctagaatgaaaactgacttttctttattcaattgtatgtagacacattgagtgtgacatttgtcaaggttggttgttagcaatatcacatacatgcatactcaagcagacttaagatagtcctttttttttttttttttttttttggtttctgataatggtgcaaagttttcctggttgacataatctcttttcttggggatcctttcttctatgtctgattattgtttatttcacctttcctttttatgaaccaggcttgttgatccggttggcaatttttgttctccttctttttaactacagccaagtctccgttgtccagggtaatggatagcctcatgcttaatgaagcagtagtggataagcaaaaatgaaccatttgcgtttcaaatttttaaaagtgcaaaatcacatagaaatgttttctggtcacacctttgtgaaggatggtgggagggtgagttagaagcgcctgaagaatcaaggtgagccagcaaaagacacagatttactgtaagtgattctatgtggataacccatgcaggaataatggagatgtggctgcagttctctcctgaatgctttgctttgttttaaagtgtgagattccccccttttttttggaatgaataattgaatgattttattttagaacttaaacaactttgctccggttattcctactgtcaagatgagccacacctgctgaatttcattttttaaacttttctccagtttattttttttctatccagttcctgtttgcttctcgttatttgctaaatgacagctggcatggaaagaaaaaaccatattatggcagtatacagacaaaattaaattttgtagtttcttttttgttatttactgtaaataataatacctcctttttaccttcaatgtaaatataaggttatttgggagtttagaagtatttacaaaataactagtgcataataactatatttttctctgaattataaatcaaatattatttattgtttacaaagttatgtattaagggaaatggaaacaaactgggcacttgaagaatttcaatatccaaagagacaattgacaaatctatttttagtggaaattttaaaaacaataagcaataaattaatttacttaggaaaatagtattatagaattaattagtggcaaatgttgattagtagaagaaacattatcatctgtggttgtgattgtccttttatatgctggttccacctttacaaggtttagttcatagcaaactgtgccagatatggacagatgttccagttgccacaatagtattaaagtgactgactagagtcaactatgccatggatttaaaaagaagaaaccttccctctatttcagtgctaagaggtggtggccacattttggcagaacaggtaatagggtgtacagcaatgatattgacagaaaacaacaaattctgcatatttttccactcataagttgatgaagagattatcttgccaaaggaagatggtagacagtttttcacttcctaattccccaaatttctttgccaatattcaccaaatttcagtattttgggtgtgaccttaaagatctgtgcatttctgtcttctctcccaatgtttggttgaaattcttcttgacatcattgtacattttccttgaataaatgcattttaatataaaattttatgtcatgtttgatatgagagttatatatttaaatacatttaaataaatgtttaccatgaaaatgtatgaattatatgtatgtttcacctaaaatcctttgtatttttccagtaataaatgagttccactttgtgaaatgttgatttgtaacaacagtgaggactccagttccttaggctggggtattttctcttcttttatgccctctagttaaatgagaaatgtagagagatggaactttgttgtgtctaatatgcaagcctataatctaataaaatttaatttgagacttttaaactgagattggtgacactgacaaaattatctaattagaagatcaccaaaacatatctaatccaagaaactgacattcagtgtgactgattaaggttcttaggacatctcctgagatatctctgataacatatatacttcttgctctacctggaacatggatgagctttaagtgtatgcaatgcaagttctacccattagtttctagcagccttgaagataagtatcagacagtttagtgttgccaatagaatcttggaagctatgtttagccaggatacatttggaaagcttactagcctttctgtactgatcctttctatgacagcaaacccattgtaaaattttccctgttcctccagcagattaacccataatatcttttaacaactttagattttttaaattccttttaatttaaaccaaatctgcttaatagaaagtaagcagttttcatgaggattctaactttttttcttccagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtaagcctcactgagagtttctcttcctcttgaaagagtttataattgccttagtgaattttacatattgctctcaaattaaatatcaactaattggccatgtatatcttgacatcaaatgtttagcatcccttttaaataacaaaaaaatgttgctaccatagtgcaaaagagtcaaagaatttatgtacaatttgatttagaattgaatttaaattgcttatttattagaagatgattctgaattgtcctccaaggacattgatctatagcaaaattctgacatatttttaagaaccttagaataggttctttaggacatgtctgtgtttactaaacaaatgataaaatatgcccaagtcagataattttgaaatatcacttgtaagtacttgaagatggactatgtagggaggggacatcatctgggggattattattttttgtttttgtttcttctacagtcttagcaatattaaatttagaaattatttatttaattttgttaaaatatatattagcatttactggatacatattgatattataatatagtatactatagtgatagattttaaagtggtcttatacagagagacaaaatgaagaaaatcacgcaaaaaagtatatttatacaagtataaaatgcttattaagttcccagcttgataaatgaacatataagcaggttatatagagattgtaaataatacggtctaaagtataatatacaatatttttaggctctgaagtaaccactatattttcgaattatatttcaggtaggacttaactgaattaaatgataaagttggcatatgttggcctcttattttgtatcagatattggactaaatggtttacattaaatctctctctctagattcccacaaaaccagtcttaagatatttactataaattgtctgtatttcgcagttgggaaactgtatccatgagaaattaacagagaaatggaaggtctgaatgctgtatcagactctgaaagctatttcagagactatcataagctatgggcaaagatcacagacgcttagagtaggaaaggataataattttacctagttcaaatttagagctatgtaagaatttcttcaacattatttctaaaaaaaagcagggtggtggggtggcaattgaaacaagaaagcctttggaggtaatatattgtgatccaaattgaatgagcttaagcaaaaataaagggaattcattacctcactttactgaagcccatttggaactagttctaggttctaacctggctagattcaggttctcagccagcatcattgggaatcagcttcttgtctctcttcttcccaatatgtgaccttcctctctggctgggcattttcctactattgccaagattctatcaacttttattctactaatgtagctccatgtacagaaagtttgtgcctcctaactagtagctttaattaaggcccacaaattgaatatcattgacctggttggagttacatggccatttctaaaccagtcagttaccctagctcttggttttaatgccatattcgcctaaatcagaatcatatcttatcactggaggcagagtaaatgagtgaaattatgaagacaataattaggataccattaccagaaggaggatggattctagaaagaaataaacaataaatagacaactcaagctggggctggtcttacgtgttaaggaatgtaggatctgtatctaaggtgaattatggaatagtagaaaatccataggcaggatacacattcttctcaaatgcctataggatattccctaggataagttataggttaggtcataaaacacacatcaataaacttaaaaaaattaaaataatacagaatatttttctgataaaaaataaaatgaaattagaaaccaataacaagtcaatgtggaaaatcacaaatatttggaaattaaacaacttgctcttaaataaccaatgagtcaataagatgtcatgagagaaattagaaaatactttaggatgactgaaaatcaaaacaaaccaaactgaaattaatgagggcagctaaaacaatatttaaagacaaatttatactctaaatgtctatagtaaaataggagatttcccaaattgctaatttaagctcctttttaataaactagataaagaatagcaaattaaacctgaagttaacagaaaagacaaatattaaagaagagaaaaacaacagagaaaaatcaataaaaccaaaagttatttctttgaaaaaatcaacacaattgacaaatctttagttgggctaaccaagaaaaaaagaggaaagacactaattattagaagtaggaatgaagagaggatattaccatggatcttttagaaagaaaaagggagcataagaaataaaataaaattaaacgccagcaaactagataacctatgtgaaattgaaaaattcctagggagtaacaagcgcctgaaactgactcaagaagtaatagactatctcaatatacttataataagtaaacattgaattcacaattaaaaaaaagaaaacttcctgccaaaaaaagcctgagcccagatagtatcactggtgaattttgccaaatgttcaatggagcgttaacatcaatccttaacaaactgttccaacacatagaagagaagggaatacttctcacctcactttctgaagctagaattaccctgatattaatgccagacaaaaataatgcaagaaaagaacacagacacaaatatagaccagccatatcccatatgaacataggcacaacaatcctcaacaaaatactagaagccaaatcacataacatatttagatttttagattatgtactctgaataagtgaaatttatcccagtgatgcagggctggaccagcataaaaaattaatgtaatatatcatattaattttaaaaaactatacaatcatctctatagatgctgtaatcacatggaaaaagccaaagtgtttcatgataaaaacactcagcaaacttgaaatagaaaagaacttcagcctgataaacaccatctcaaaagaccccacacctatcatcattcttaatagttactttagatgcttttatcttcaggtcaagaagaaggcaaggatatttgctcttgctacttcttttcaatattgtactgaaagttctaaccagggaaataagacaagaaaaagaaattaatggcatctagattggaacacaagaagtaaattctattaacgaatacataatcttgtatttagaaaatcctataaaatacacacacacacacacacagctgttagaactaataaataagattgcagaatacaagatcaatatacaaaactcaattatatttctaaacactactaatgaacaatcagaaaataaaattaggaaaattctatttataacaacatgaaaaataataaaatacttaggaataaatttaataaaataagtgtgagatttgtacactcaaagctataaaatattgttgaaagaaattaaagaactactaaataaatgaaagcacattttatattcatagattagaggaaaatattgttaagatggcaatactcaccaaattaatctacaaatttaacgctattcatatcaaaatcccagctacctattttgcagaaagtgataaattgactgtaaattttatatgaaaatgcaagagactatatgccacacaatcttaactagaaaaaaaataaagttggagaactcaaacttccaaattttaaaacttactacaaagcaaaagtaagcaagatagtttggtactggcataaggatagctatatacatcaatggaataaaattgaaattccaacagtaagtcttcatatttatgttaaattaattttcaacaagaccactagacaattttattaaggaaagaagccttttcaacaaatggtgcttggacaagtgaatatccacatatgaaagaatggaattgaacccttacttaataacatatataaaaattaagataggtcataggcctaaaggtagagctaaaactatgaactgttagaaggaaatttagaagtaaatcttcatgacctattattaagcaatgatttcttagatatgataccaaaagcacacacaatagcaataagaaaaaaaaggttcattggactttatcaaaattagaaactttcatactgcaaacaatatcatcaagtaaaaagacaacttaaagaatggaagaagacatttgcaacccagatatctgatcatgatttgtatctaatatatgtaaaggattattataactccacaacaaataaaatagataactcactaaaaatgatcaaaatatttgaatagacatattgaaaaaggagttagacaaaaggccaataagcacataaaagatggtcagcgtcactggctaattttaggggaaaggcaaatcaaaactaaaatgagataccacttcacacacactaagatggctataatcagaaagaaagccaataccattttttatcaaggatgtggaaaaattagaatggttatgctttactttgagaatataaaatgatgcagtcactttggataataatttagctgttccccaaaaagtttggggtagagttaccacatgacctggcagttttactaatttcttcggatatatatatctaagagaattaaaaacatatttcaacatgaatgcttatagaatattattcataatactaaaaattaaaaacaattcaaatgtctatcacttgatgaatggataaacaatatccatccaataaatgttattcatccataaaaaagaatgaagtattgctacaatctacaacatgaataaaccttgaatatattatattaagtgaacaaagccagtcacaaaatttacatatcatattgctacatttatatgaaatgttcataacaggcaaatccatagagacagaaaggagatgagtggttgccaggcagtagggattagggtaaatgggagcaacaactaactaatgggtatgcagcttctttttaaggcgatgaaaatgttctaaaattcaataatggtgatgattttacaagtctgtgaatatattacaagccactgaattgcatactaatatttcatagtatgcatgtatcactattttttcttccaatcacctattgatggatgttcaagttgattccagatactttacccccatgttgcagtaaatgttcttgtatatatcacctttcataatgctgtattaacttctagaagatagatttccaggattgaagtattcccaatattaaacatattcatgtcacataaaaattagatgatatgcaacgaaatagggaaatgtgactcatagttaatagattaaagcggtacatagaaatagatctggacaggaacaaattgttagaataaacaaaaaaggactttggaggcactattgtaaatatgttgagcaatttaaaggaaaaaaaggggtcataaggaataaacagagaacatgagcagaaaaaaatgaaaactgtaaaaaggaataactcagacattttataattgaaaagtacacattctaatatgaaaaattcactggatgtgtttaaaacaaaattgcagatgtcagaagaaatagttgttaacttggagcacattaatagaaattatccaatttgaacactagagaattaaaaggaaaaatgaactgagtctaactataatatgggataatatcaagtagtctaaatatttatataatgggagaatcagaaggagaaaatagaaagaatggaacagagcaaatatttgaagaaacaatggccaaaaatttcccaaagttggtgaaaaatagtaacttacagaccttaatgttaccttataaaatgttagtgaacatcaacaggataaatataaagtaagccatacttaggcacatcttagtcatgctgctgaaaacaacaataacaaaaagctttggaaacaaccggaagaaaaatatttactatatacatgagactaatgtcttaccagaaataattcaggccagaagaaagtggccagataaaataaagaaataaaagcccattattctacagaaagtgaaactatccatcagaaattaaaatgaaataaagaattttaagataaacaaaaacctaaaaaagctgttaccaccagaactacactacaagaaatgttaatggaagttctttaggccgaataggaaaaatatcagatggaaatttgtttctgggaatgatggtcactagatatgaataaatgtgggtaaatacgaaagactatctttttttccttaatttttttcacatttattttaggttcaggggtatgtagacagctttgttgcataaataaattgtaaatcacaggggtttggcatacagattatttcatcatccaggtaataagcatagtactctatagatagttcttcaattctcatcctccttccaccctccaccctcaagtgtctgttgttcccttctttgtgttcctgtgaactcaatgtttagttcccacttataagtgagaacatgcagtatttggttttctgttgctgtggtaaattttttaaaaagacaactgattgtttaaagtggggatttataacataggtaagtgtaaaattatgaaaagatttgaacttttttttttttttttgagacggagtctcgctctctcgcccaggctggagtgcagtggtgcgatctcggctcactgcaagctccgcctccccggttcacgttgttctgctgccttagcctcccgagtagctgggactacatgcaccagccaccaagcctggctaattttgttgcatttttagtagagacggggtttcatcgtgttagccaggatggtcttgatctcctgacctcatgatccgcccgtctcggcctcccaaagtgctgggattacaggcatgagccaccacgccgggccagaacattttatctaaagtgttacaatattaattttacatagaaaattacaagaaagtatccctcatgaacacagaagcaaaaaatcattagcaaaatattatcaataaaatctagcaatagagaaaaaagtaataaatacttcttaaacatgtggggattatctcagaaaagtaagattcatttaacatttgaaaagtgatcaattaattggccatattacctctaaaagaataaaggaaagcctaagatcatctcaatagatgcagaaaaggatctgacaaaactcaacagtcatttgtgagaaaaactgtcagtaaactaggaatagaaagtagctatctcaagttgttaaggacgtttcagaaaaccctacatctagccgggcgtggaggctcacgcctgtaatcccagcactttgtgaggctgaggcagtggatcacttgaggtcaggagttcgagaccagcctggccaacatagtgaaaccccgtctgtactaaaaatagaaaaaattagctgagcgtggtggcaggcgcctgcaataccagctaacagggaggctgaggcaggagaattgcttgaacccgggaggcggaggttgcagtgagccgagattaagccactgcactccacacttcagcctgggcaacaagagtgaaactctgtctcaaaaaaaaaaaaagaaaaagaaagaaaaccctacacctaatattttacttatcagtgaaatgttgaggtagtgaattcttgccccttagaaaaattgagtgctttccccttaacatagacaaatatgtctatttttaccatttttatttgaccttgcactggaagttttatcaactgaactaaaggaaaaaaaaacaaaacaaataaaatgcataaatattgaaatgtggtaaattatctatttcatcaacatgatcatattgtagacaatcctaataaatctttaaaactgattagaaataaacgcgatattaaatattttatttaccataatatcaaaaaacacgaagaatatagtaataaatttaacaaatcatttcgagacacctattactaaaaacctcaaaacatggctgagaataattacagaagatttaaacaaatggaaatatatatgccatgttcatgcaatggaagattcaatattattaagaaattaattctacccaaatgtatctatcaattcaacccaatcccagtaaaaatgtcacagattttctttgtagaaattgatgaactgactttctatgcaaatacacagtgcttaaaattgccaaaacaatactgataaaagaataatgaaaacattaacctacctgacttcaaggcttgttataaagctgtactaatcaagaatctacagtattggcataaacaaagatatcaatggaacataatgctgagttcataaatagatccaaactacatgtcaatggattttttgaaataaacactacagaaaggaaatagaagaaaggaagtgttttcaacaaaatatcaggaacacataaataaatgtatggaaaataaatgaacctccacttcgatcttatgccaagtgccagaatcaataaggattgtagactaagcagaaaagctaaatcaataaaacatctgaaataaaacacaggagaacatctttgagaccttggggtaggcaaaaatttattggaaaacagacaaaaagtgctatctattatttaaatgtccatgaaatttcaaacaatggagacctactgaacaaaaaagaaaagtctagtaatatacacatgggtgaatttcaatttgaagtattcaagtaatatttggaaaagtcactaagactgtcaggtctctgaggtaaccacctaggtagagagagattccatttactgagttagcaaatatcagaagagaagcaaaactgtggagaaaaagcagtaagatgaattttggacctgttgaatttgagatgcctgggagatagtctttcaaatgtaggtattgaataggcaggtgggtatgtatttctagagactaggaggtatgcttgaacagaaaaatagattttgaaatatgaactattataaaaatgtaacttattataaaaggaaaactaaagtaagaggggtctagacagagagagttctgaataaatccagtatcaaatgatttgttagaggaagaaaatcaggtgagtagcatccagggaggtgtggatcacagaagctaagggcagaaaatatttcaatgaacaaggaacagaaaacaatgcctgaaacttctaaaagggcaagcaagcaagataattgtttaaaaaatttcgtttggatttattggtgatgtcggtcttgttggtgaagtttgttaaagccatttggtgggttgtggagtaaggtgaagaaatggaactggcaagtgtagacaagtatgcaatcttcgaaagaaatctggccataaggaaaggatagatggtggcacctggaaggggaaatagagtgcaaggagagtttctcttatgacagtggtgatatatatattttttgtttgtttgtttgttttttgagacggagtcttgctctttcgcccaggctggagtgcagtggcgctatctcggctcactgcaagctccgactcccgggttcatgccattctcctgcctcagcctcccgagtagctaagactacaggcgcccgccaccgcgcccggctaattttttgtatttttagtagagaagaggtttcaccgtgttagccaggatagtctcgatctcctgacctcgtgatctgcccacctcggcctcccaaagtgctgggattacaggcgtgagccaccgcgcccggcccacagtggtgatatttttaagggagagaaggactcggtaactgttactttctataaagaaacgggaagtagccagtagtagaaatgttggttaattgagaatgaattccttgcaaagtccaaaggaaaacacataacacaatttgagagattagctcaaaacaggggcacttctttcattttaacaagaagagaaaggcaaagcacagttacggatgtaagtagtctagtagataaagggaaacaaagttcaggctggctgactttcatcacctctaagacgctgaagtactgagactgtgcttctcagatgggaaggcataagcaaaaatggctgaggttatgtgcagaagagaaagtttgaaatagttttagataatagaaatggagaaaggaaaatactgcttccctttcgccaacaaaaggaaatttttttaagagttcttactatctgtagagctagccgtgagcatgtttattacagcttacatgacatcttagcaccagtctcatctgcagggccaagggaggggaccaatccatttggcttggtgatggaagcccgcactgctaggtaatcatttggtaagtttttggagggctagaaagatcagagacagagccaaacagttgatcacaatgagtcagttgcacctttcatatgaaaataatattaattttattgacttaatccgtgtactctttatcatttgataaacattatatatagtgaacaattattgatttgaatgcaaagcatttgtagatactaagttgttggacctaaaccaattttttaaaatcagaatttaatttatatttgttgggagtaaattaagttgctcaataattattcgtgtttcaagagtatttgctcatataatgaactacacttctcatttaggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctggtaaattaactgggagtgttcataaaatgtactttgtaattaattagtcttcattctcatctagtaaaaatggcaagatttcccatcattataatattatttgaatacacttctaaaacaaattggattgccataccaccaaatggtagtttcttcttcatcatagctttaataaagttcacttaaatgaatagtctacacttctcttcttagttattgaatggaaggctaatagagaggaggaaacagggagtcacagataaactcgaatcacaattaaacaacaccatagtcaactctcagttatctgaggtttgcataactgcgtacaaagcttccttgggacctaggatgagctcccctttctgccaggaactaaagaattatggaattgttcattgctcaccttgtccccgtagaggaaagagttaagacaggggatagtgtacaaaggagaaggataagcaaacagagctccccatatgactgctgccacatcagaaaatcaccaaatcactctttgaaagagttaactgtactatattttgttaattttaaagaaagtatctttctttgatcttttataaaaactattagatcttaaaattcagagataaaatatcacttgacacatttccagtgaaagtttgatatgttttgttatactattactttgagttggctctaagttagtgatttattttcaaataacagaggctgtacacggttactaaggacacgttcctatagatgatttaccttagtagtgattaggctgaagactttttcatgaaatctgtttacaatttccctttctgctttcaatgttcaaatttgagttgtaatccttagaactatatttccttccctaatcctcaaagatagttatgaatctaatttgaatctagaaggatgcaaaaaacagaacaaaaatttaaaatgataaaacaagtaatatgggcaagaacttaaaaaaatatatttagtaaaccttcatgatagtgtgatgcagttaagggaaataggaagcatagtatcactagaatcttacttagtgtgtcaggctcttttgcataaattattctctggaataaattaaatactttggtgcatgtatttactcctttgggtcactttgatgccattaaataatgcactactttcagcctgacatttactgaagcatcagaaataaaatgctgctgctctttaaccataaatggtacttcagtgaactctaaagctaatacaaccaatatgtcaaacacaatgagaaagacatttacacactacactgaattaagtctatgaagatataaaggttaaaaagaagcctagcgttttacttaagtttaagtatttttgtatttgaatataatatatgtttaaaatatagcctaaagttacagcaagctaaagatatagctagattaaaacaatctaaagacaaagaaattagttcatttctgcttccactttatgtaatttaagtgttgatattattctcacctgtgcatttcagcatatttaaagtacactgaaaactatatctgctttggccttttaaaaataatgagagttcctacttctctgaaactggatctctgctaattaaccaccattaatctgaaatatcttaattccttaaggagaaacaaaagtgtatattacatatgcttatgtaggatacttgaaaatttggtgtatcttattaaactgccaatttaaaaactgtataatttaattatttcatttacagtatggaccatttcaaaatgaaaaaaagaatgctctatggtagcaagtcactgctatatttgttagtgatcatttgacaaataaataattcatcattctataattgagacagttacctgtacatttgccctgttaataaaattacagatttttcccttcctgtgtccatgtgactaacctgcacattgtgcacatgtaccctaaaacttaaagtataataataataaaataaaataaaaataaaaaataaaaaaataaaaataaaataaaattgcagatttttttagaaatgcagagcattaacactgttcttgcttttatttccagctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggtatgtagcaaaaacattttcctcattttcattaaaagataatgtaatcattaaaaagtgtgttcaactgaagaatattttgtattttttaaatcaaggccacttcctattgtctattactcatgactgtaagagccatgtatagtttagaccattgtaatccacacaaacccttaaactaccttttgaaccaaagttattctttctttcattatccttcttgctacaaggagagaaacttttctgttatttatctttcagttcttgtactagagcatggaagtgttacttagaacactcattttatttataagtactagcaataacacctgaaaacgtttcagatttggttttctacaaatttaaaaactagcaacaatctcagtttattaagagctcatggggttttcggtgcctagaaactatggtatgagcaagtaacattgtctctaaaaacattaattgtcatttctgcataaaattaaccacccctaacaccatatatatttaggatagttagctcttcttgttgcattgatcccttttaccattatgtagtgtctttctttgtctttttttaatctttgttggtttaaagtctgttttatcaaagactaggattgcaaaccctgctttttttttttctttccatttgcttggtaaatattcctccatccgttttttttgtgcctatgtgtgtctttgcatgtgagatgggtcacagcacaccgatgggtcttgactctatccaatttgccagtctgtgtcttttaattggggcatttagcccatttacatttaaggttaatattgttatgtgtgaatttgaccctgtcattatgatgctagctggctattttgctcattagctgctgcggttttttcataatgttgatggtcttaacaatttggtatgtttttgcagtggctggtactggtttttccttgccatatttagtgcttccttcaggagctcttgtaagtcaggcctggtggtggcaaaatctcttggcatttgcttgtctgtaaatgattttatttctcctttgcttatgaagcttagtttggctggatatgaaattctgggttgaaaattcttttctttaataatgtttaatattggctcccactctcttctggcttgtagggtttctgccgagagatctgctgttagtctggtgggcttccctttgtgggtaacccgacctttctctctggctgccattaacattttttccttcatttctaccttggtgtatctgacaattatgtgtcttggggttgcttttctcaaggagcttctttgtggtgttctctgtatttcctgaatttgaatgttggcctgtcttgctaggttggggaagttctcctggttatcctgaagagtgttttccaacttggttccattctcccagtcactttcaggtacaccaatcaaacttagggttggtcttttcacatagtcccatgtttcttggagactttgttcgttccttttcattcttttttctctaatcttatcttcatgctttacaaatttaactcaacatggattaaagacttaaatgtaagacctaaaaccataaaaaccttagaagaaaacctaggcaataccattcaggacattggcatgggcaaagacttcatgactgaaacaccaaaagcaatggtaacaaaagccaaaattgacaaatgggatctaattaaactaaagagcttctgcacagcaaaagaaactatcatcagagtgaacaggcaacctacagaatgggagaaaatttttgcaatctatccatctaatatccagaatctacaaaaaacttaaacaaatttacaagaaaaacacaaccctatcaaaaagtgggtgaaggatatgaacagacacttctcaaaagaagacatttatgtggccaacaaacatatgaataaaagctcatcatcactggtcattagagaaatgcaaatcaaaaccacaatgagataccacttcacgccagttagaatggcgatcattaaaaagtcaggaaaccacagatgctggagaggatgtggagaaataggaatgcttttacattgttggtgggagtgtaaactagttcaaccattgtggaaaacagtgtggcaattcctcaaggatctagaaccagaaataccatttgacccaggaatcccataactgggtatatacccaaagggttataaatcattctgctataaagatgcatgcacacgtatgcttattgcagcactattcataatagcaaagatttggaaccaacccaaatgcccatcaatgatagactggataaagaaaatgtggcacatatacaccatgaaatactatgcagccataaaaaagagtgagttcatgtcctttgcagggacatggatgaagctggaaaccattattctcggcaaactaacacaggaacagaaaaccaaacactatatgttctcactcataagtgggagttgaacaatgagaacacatggacacagggaggggaacatcacacactgaggcctgtcgaggggtggggggctaggggagggagagcattaggagaaataactaatgtagattacgggttaatggatgcagcaaaccaccatggcaagtgtatatgtatgtaacaaatctgcatgttctacacatgtatcccaaaacttagagtataataataatttaaaaaaattaaccatacccaacactagtgtcctgaatcttgaaggcatggagaagttgggaaggcatgggaagataaatataacaaagtgatataacatgtactcaaatagaattaaaaataggaagtaactaatatgtgtccaaaaatatgaaaacaaagtgccatgtgtcaagtttacaaaatgtaaaccttgctttacaataggaaggttgatcagggaagtctttgtcaaagagtttggacctaaaatatatttaactgagatgtaagatttagcttggtaggaagaaagaccatcccaaacaaggaaacaaggtacccagtgactgagggatacaggacagtagactctgtgagaagtatcaggctcttatgctttaaatatgaagtaattacaccgagttgcttaattagaacccaaaccaatggaatagaaaaatgactaccataacaagtaatttaatgtatatactcttgccaggctcagtggctcacgcctgtaatcgcagcattttgggagactgaagtgggcgtttcacttgaggacagtagttcgcgaccagcctagtcaacatggcaaaaccccatctctactagaaatacaaaaattagccaggcgtgatgatgcacacctgtaatcccagctacttgggaagctgaggcacgagaattgcttgagcctgggaggcagaggtggcagtgacccgagattgtgccattgcattccagcctgggtgaaagagcgagactctgttgcaaaaaaaaaaaaaaaaaagcatatactctttagacatgatttcctctcatataaaggtaacctccaagtccccaaagatagagaaaggggaagggaaaaaggcaaagtattattttatttttattcattgccaaatttcagcctcttcaacattacttttgataattctgatctatttttaaagtaacaagaaacataaacagtgtacaatctagaattataaacagtggcttaaaacaataaacactgattacttcatagtttctgtgggtcaggatttggggaataagttagctgggtggttctggtttaggatcagtcatgaagttgctgtcgagatgttagctgaggttacagttatcttgactggggctggaggatcagcttctaagaaggctcaatctcatgattattggaaggaggtttcagttcctttttggcagttagttgaaggtctcagtttttctctgcaggaccttttccataggactgttgagtgtccttatgatatggcagctggcttcttccagggaaggtgatgtaagagagaaggcaaggagaaaatcctctttatgttctactcttgaaagtcactcttcaccacttctgccatattgtattcattagaagctagtcactaagaagagctcaagctactataatccccaagacaactttaaaatgtttgctttcagaaaagtataagatcacatagaacagaaagtgccatagggttacatagaacagaaacaaagaaaagataatataattatgttatagatttgatttcattttctctgtatgtatatttggtatatgttggaagaagaaaagaaaacgcagagaacagaatcctttatgacaacatgaatgatcagacagcaatggggaattaagaaatataagtttgggaccagattgggtagaatttaatttatgaaaaggctgactgtgcataataaaatgtattttcctttaggcaattcaaagctacagatgattttttatcaggaaagtgacagtgaaccagtgatatttttcagaaatatacgtagcaggagaatgcagaatagatttaaagaggatgaaactcagcccaccacatgttatctattagtttactgaaattaacatatctctctaatgtataaatgtgcagaaaattgaagttgaaaagagaatttcaggaaatatcaagtacttatggttgacatcagtattaatttagattgtgatgtatgcataaaaagatatagtttataaaataatcatttccatctactgggtgtaaatttaatttttgttcttttaagagagaaaaattaaaggttctcctttctttttgactatcagttaaaataacttctttgtcttgtgataacctgggtatgtttctggagtagctaaggtagtcatatatatcatgtttaccactattaaggaaatgtgcttatataacatttgcttaagactgaatgaacttgatatactcactccttactacaattcttccttcctattctcactggaaaaatgggaaaggtgtcccaaagacaaaatggcataacttccttttaacacacatgaactatcagatgtggctccacccaaatagatgtagtagtcacaatggatgggactgccagcctagtctacagacaagacagagctgggaccacaaactactgtttcccagaccaggatttttatgagccattcttagtttccagacacgatggcaagagacccttcattggttgaagataggtgctgcagaaaaagaatgtgactttctgaaaactgatagttctagaagcagagaagacaacttcctctctccctaagtgaaggtgaggcaatagcacacaggagggatgtgaaggttttggcttcctctcacaagttgggaatcaggatggagaaacaattaaaatatgtaatatgtttcaaccttgaattcaaaatggaaattatggtaacatttccattccaagaggctaatttgagacacaagaaagagttgatttcatttactgagctagcacatttgtgaaacaggattcaggatttcagtccctgagtgagcttgctgaactgttttctttcttttttttttttttttttttttttttgagacggagtctcgctctgtcgcccaggctggagtgcagtggcgggatctcggctcactgcaagctccgcctcccgggttcacgccattctcctgcctcagcctcccaagtagctgagactacaggcgcccgccactacacccggccaattttttgtatttttagtagagacggggtttcaccgttttagccgggatggtctcgatctcctgacctcgtgatccgcccgaggcctcccaaagtgctgggattacaggcgtgagccaccgcgcccggcctgaactgttttcttaaattgtcatggatcacaccaaacacctgtgccagctgttatgcgcatacccttcggtaacaaaggaagtccagaaaaagagaataacttgactcacacaaatatttctagggaaataaggtaaataaaaagatagtgttgtggaggataagttggataatagtaagtgataacagctaaactttctcaaaggttcactatgtgccaagaactgtgctgaaagccacatgaattctgtcactgaatcctttcaacaaccttgtaagctgggcactagaaaaacgattacatttattttatagatgaggaaactgaggctcagattggttatgctacttagtaggtaacagaaaatcgattcttacctagcactcgaattctaaaatatgtgctcctctatgtcaagtaatctatagaactaagataaacatgctgatgaaagttagtgtctagtgggtattaataaacgcggtttcaaaactgtgtcaccacgggtagattggctgctttaaaaaaaataaaaacttcaatggatttatgagaaagaaaagtcatatgttccagggatatttatttattttcctgacagtggaatagcattgaattgagttatcaattcataaaagatcagagaaacaattcgaaaattaatagtaaaccctattatactgactaaatatggtagcagttcaaagaaaggaagtatcggtaagagtaaacatggaatactgtttcctcacttattctgcaaacatcacaattaggagaaaagaccttgtagttagactttcaaaaaaaaaaaagcttctctacttattaactgtggtcttggacaagtcatgtaagttgtgcagaagcattttcatctgtaaaatagtaataattcctgccttatagagttgtgagaaataaatcacataaaccttgaaaatgctttgcacaataactggtatttactaagagctcaactaaaaagctggttttacttttattgttattatgatctggtattgatactgctctaggacttggctctaaggcatgtttctgaccaaaagatctcccaatctatcagtaaagctgtgcttgttttttttttttttttaaagaatccaatataatgtgatagggatgtggatgagaaatttaacaggacagaatgagaaatgggagcaggctatataaatgtcacagtaaatgacatttgtaaatagagtatttgtccagtacagaggcaatataattggctcccgccctggggaaggattgatggatgtgtatcaagaaaaatttccaaatagacaaatgacagaactttaatatactttaggaaaataagtctaggaaatagcaccaaaatagataaaataaaaattttacatgcaattttttcttcctttgtctgtttttttaatccaaataataagttcaaaagcaaattacaataaaacataattttattggtaaattccagaggcaaaggagcaggtctggtcttaatgtgattatcaggagtcatagtatagagactgacagattgtcagtacactctcaaaatcaaacgtggtcttcattggatcttacatatttttactttaaaaaaaatcaccattggttagactaacttacaactaattagacaaaggtgctgtaagcctcattagcatgatagaagcatgagaatatagcaagaatgtagaatcctttttattgaagttttacttaaaaattttcctaagattctacttttgtactacagtttgagcatccctaatctgaaaatttgaaatccaaaatgctcggaagttcaaagcttttgagcaccaacctgatactacaagaggaaaattcacatctggcctcctgtaatgaatcgcagttaaaccacagtcaaaatgttgtttcctgaactaaattattaaaaatattgtataatattaccttcaggctatgtgtatgtgtatgaaacttaaatgaattttatgtttacacatgtgtctcattctcaagacttgtcattatgtacatgcaaatattttaaaatctaaaatccaaaacacttctggccccaagcatttcaaataagggatatgcaacttgtatttactttgtgcatttgcccccctttactgctatatctttcttttgttctgtatgttatgtgtgcttaaataatcaggaattcattgatattgtcaatcaaatcctgaaaaaaaattatatgactcagtcttgtacccctgagaatgtctgatttcttcgtaagttgtctttttttttttttccacaatagtgagtttaatgtcatgaatcttttcactcattcatactggtggagcctatttttaaagacccaatttgcagactgattactgtccttattcatggcaatacttcaactccacaatctttaattcaacaataacatcataattattgtataataaccattttatagtatttctcactattgtataattatagtagccataattgtcttaataaaaattgggacttttcatccagcaataaatacgtttttgtctgatttgtccagttatctaggtacaaaaaatggtacaaaggcacaaaaataaaatcatatttaaatatattgggataattgttgattttaggaataaattatcagtgtttccggaaatccaaattacatagtcaaaatagcatctgtattaggccattcttgcattgttacagataaatacctgagactgggtaatttataaagaaaagagatttaattagctcatggttctgcagtgagcttggtgctggcatctgcttggcttctggtgaagtctcaaagagctttcaatcatggcagaaggcaaagtggagcaagcatttcacatgatgaaagcaggaacaagcaagagagaatgtgggcaggaggcactacaaacttttaaataacaacatctcatgagaactcactaacatgaggacagcaccaaggcatgagggatctgaccccatcatccaaacacctaccaccaggccccacgtctagtgctggggattacaattccacatgagacttgggagggggcaaatgtccaaaatatatcagcatcccaaataaaagggttttttttgtacagttgtctatatttatcttttggaactgagcttaatagaaatgtttcatttagcaatgatttcagtattttctgcaatgactaaaaagcaaatagtgataatagtattattttatattgaccaagcatttttatttcattcactttttttcagaatagtgtatcatgaattagcagaaatgcatgttagaataaaataaggtgtcaagaacaatcttagaaaactaatgatggaaagcaattgaagcaatagaatgttttgatcacctgtttttcctgctgtgtttcaggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagaggtaaaaatgtttaaataaggagatattttggtgttatataattctgttgtttaaaattatcaggtgtttttaaattgcgtgtttccttcctgttaagaaaatagaaaatatctgtctagcaatatattttccatggaaaagttggtaataaataaattaatgatagattaaaatatagctagattaacaatatgctgacttatgtttccaatactgacattttgaattcttgacagtattcttgatatgaattttttcagtatttataaataattttaaatttctcaaaatgcctcaatttctccactttcttccttgtaatttgcccacaacagtgttttttgtacgtactggaaaaatatctgatgagagggtagttgcaattctcatcttgctatgttcttagttcttaattcttacgaaatacgtcataaaatagtattgtattttgtttgcacagacatatttactcaaggaagatctgattgggatcttggcttgatatttatgtatagtttatctttcctgaagtcagtcagtttttttgaagagaaggtattgatgaggaatcacactaaaaacatatttaaccctactgagctcagtgttcactgtttaaagaaacaaaaatccttaatacattatagaatgtaaaattctgaatttaccaactcagtaagtcctggtaacttaatgtattctttgatttacaagaagggtatgagcaacagaatatattttttgttttgtttgctattaacctgttgctcaataagtacagagttggaggtaaagagaggaatttaaaaccttgatatttaattgtttatacaaaaatgaagacaagatttccagtaattaaagtttgcactaactaacaaaaataacaaggaaaaacaaagattcgttccttcctcatacgaactgtttggcgaggaagataaaagcttctattcctgatgtcgggaaagaaagaatgacgacatgggggagtgtgggcactgaaaggtaaaatttaagtagcacaacatgatcatgataattaacaatcagccaaaattatgagggaaaatatagttataaaaaaagaacaaagatgggtggatcacgaggtcaggagttcgagaccagcgtggccaacatggtgaaaccctgtctctactagagattcaaaaaaattagccaggcgtggtggtgcgtgcctgtaatcccagctactcgggaggctgaggcaagagaatcgcttgaacccaggaggcagagattgcagtgagccgagatcaccccattgcactccagcctgggcaacaggatgaaactctgtctcaaaaaaaaaaaaaaagaactagctatttcagacactttttctgtatttatttgataaaattactaaagagtatgttattttccattttttcttgtttgtaagttacgtagtattgctgttagtgattaggtagaagtagatgtttaatgggaaattcagacaatctttgaatataggaaggtataaataacagggacataggtatcagtttcacaagaaataactgatgagattcaagggaaaagtaataaaaccttctgtcctggggcaaagaattactttaattggttgaacttaaatttttactaactagattattgtttgaaagttgaataatatcttaaaatcttattaacaaaattttgaacaagtgttgttacaatagttgggttatgctggaagggtggagtggcccaatttcatatacagtgtactgctcttatagaagctgaagtcggcatttataaaatagaattcggtcatttgaattttgatgtatattcccctctcattattttgaaattatgcctaatggtgaatatttccctaatagtaaaaaaagtcaatttttattttcacacatgtttagttttaggctgtcatataaactaagaatgaattatacagtatcaaacgttgaagccattggctagtttaatcttttagctaagtttcagtatcttttgaggaatgtttaacttgacatccagtcttcttaactttaagagattttacagccgtgggttttccaaaagagcgtgtattttgccttaacttaagccattatgtctgaagtaagagggaagtccagtgatgtggggtttagagtagggacatctcttgtttctcttgttatcattaagctttttgatttgttttcccattaagttagctctgagttaaatactctaaaataatatttgtgaattcagtatttcagaattggaggaagagaactgacctgccaggtggaagcagacaggattattttattgcttgagttgtggagtccttccaataccttcccagcatagagactgttacttcagtgttaacattatttggaggggtttttaattctggctttatatcaaactttctagacataaatttataaaataataaatgatgagggttatcgccgtgaaagaggttatgtgtaggttttgatctttcagaattttacctggtagctctacactaaaaaactagagaattaaaacaattattgaagaatttcagacactcgcatttgaaatagcatttcttgcctgccttctagtcatttttgtctggtcatttttctaactgggggacaggattacattgttaaatatcacaaagtagtaagaaacatcatgaggcttattaccaatcctttctaaattaattttttaattaaagaaaaaatgaggcttttttactggaatgtctaaatgaatttttttataaggcagactgagtggactcagaggttttttaggtgttcacagtaagtcctctgcaatgtctttgctaaatttgtatgattcttcagtagttttctgtagattctctagagtaggccatttaaaatcatgtcataatcccctatgctttaattttaatgttatttcgattatattaatgtaattccttttgtgattttgaatgattgttttttcttttagagtatttaataatgtggaagccatgcttgaatgactatttttcgaagtgaaatttagtagtgcgatatggtgaccttcaccgcttaccattcttacttctcacaggagtaaaatcaagctggagccatcaagaatgcagctctggtgttttttaaccagccagaggctcgtgccaccacttttacccaggttacccaagcaagttgtacatctataaatataatcagtttctaaatgacttttgactggcctgcatgttactcagctacgttccttgcccttccattggcagtaaaataaaaacatgcacagctgctattatgctgagtcatacaaagcatggtcaggcaagtctgacaaccctaacttaaaaaaaagtgatttagctgctaattttcttacatagattttaatagaaattttattcaatgaaaagtaaaagtgcatgcctttatggattatttaatttccttttaatgttacagagttttgaacatattaggagcccaaaggagaaatgtaggtgctctttgaaaacttgcaaaaatgctttttatcctctgtctttaaaaaaaagatagcccagttactgtacttaagtcttgacagttttttatttagtgtaatgtttttctgaagggtaatcttcaaattaaagcaatcccttattcatatgcaaacttcccaaaggatgttttaatgtgataataatgtaaatgaataggaatgtctgtgtttcagttgctagcagcatgggtataatatttatctgcttcattttagggaaaatggcactgctttatttaggagttgaccaacagtattttgtatttagaatataatttctttggaaagtctgtttatatttacccttaaaactcttagactgaaagaaaaggaaatcatgtcttttgtataccaaataataataataatagtgataatgagagacttatagatggtatgctccttctaaaaatagatttagagtccatcttcttcattttcttggctcctctgtgctttctctcccctctattttattgagacctgctggaaaactttctcccgaagaatattatttaaatttatcatgatccacaaactcctgtataggaaaagaatcagaaactcttgctcctagggtgtttttaaaatgaagagacttccctatcatgtgacaatagcaataaacgtaacatcattctatgggatccattagtcgaccttcatttcttaatgttgaaatcacagttttatgcacaaatatttaaccaaaatgcctaaacccaatttaatcatttttaagaaatgttaattattttgtcacttagatacagtttcctctccttttgccaataaaactataaaacagcactaatataaaagtgtagttggctatttggaagaagcaataatcatgccattcctggagcattcttttatactttggaacaaaatattccatcactggctctccagattcatgagctataatgcctcatatattggaggaatgggatgtaaaatgggatccaagatgcgtaattgtttacagttaaacacagatgcgcatatacacagggactacagataattactttttcctattatgtattaattcttcagaaaagcatgagatttaggcactttcggataatagcttgtttctcggaaagaggcaagggtagtttccttattctctgagtatcccattttgccaatttcctgtttagaaagatacttgaggcatattatccatcaacgtatctaggggattcagctggagtaaaggtggtagaatagaagctaagaaggaactggttcgtttattttcaatcctcacattatggcaatttttgatttccttgtaaaagtctatgattctccctcaggaaacattgtccacttcctaaaaaaatatactaatttctaatacaggggtttggaaaggggacaaaaatgtgcagggaaggtttgcgtaagcaatggtggaatgggttcaacagacacctgtctatgactttatcctggagaatgtgtagtcctcatgggaaagttttccagtgggatagtgattaagatggaaaaaaatgcccaaaatatctttaatataagaacaaaatgggccaaacacgtgtctttgggtcactggtaatctactgagcagtaggacatcatgacataagagttccttttgccatccgaagaaaaatatttaaaatcctattatttgtggttttaaaaatgttataatgtattcattataaacactaaaatgactttctggataatatagtatactgtgagtaattattttgattttaccatattcttttttagttctcagaaaccaaaattgtcagatatgggatacttgatttaatctgtatttgaagttttctcttttttaagtgccaattttttaattaaattaaattaaaatctctctctcttttcccaaattatatacaatatctactaattatgttttcttcgaaatgtatcttagcttcataatgagaagtgagtgtgcccatgaaaaatttaataggaagttatgttttctcttccattttctgttgtgattcattatttttgaaaataatttactttcatttgctcacatttgctgtctaaagaaaaactattcatctggcacattcatatttagtagtattattaaagcagaaagcataagttggaagtataatatctaaaaatacaaaatgaagtattgtaccttgatgtttattagatcattaagcaaaatatgattctgccctgcttaaatcatttgattataattatccagcatataaaagaatcacagtagattttcaataggaagagtcctataatattaggtatccaccaaaaacattgttcaagtaatatttccacctgaaagtaaatgattgccaatgctttttttcagagcatataaaattggctattcctatttgatctcgttattgtcctggcatccttattttgttaaattttaactaggcaagggctatgctacaaacatcagttagtccgctagtttcctgataaataagtacaggtaattaaaaagtgaacctaaatatccaaattataccaaagggacatatatagaactttttaaactggatctgcttctagccagttcatattttggtcacttactaatgtagtatttcaccataaattatgcctagattggagcatttacaggcactctttatctgaaaattcttaagtgcatgagttgtaacagtttcacatagtgatcatctcactgttctaattggtgactatgtactacagttaggttgatcgtaattatgaccttaaatgaagctgaatatttttatattcctaatttgattaattttattttatgggcttttacacattttaactgctttagtcaacatattttataatattatgacatttgcctagaatgtaattttaagaaagtcatttaattgatgttatcaagaagggttttataaatcagaatttcctgcctatgtttcaagatcattgcttaaagaaaactttttgttcatgtaatattccaatgtgtatttagctttactctacattaaaatatgttaacaactatgaatataacttgaattaatactaaagttcatggttttgaaacatggaaatcaacaatatcataagcactatcttgaacctacaatatttgattacatatctagtctactaaatgttttaaattgataaacattgggtttacttttgaatcatcaaaaagattctttagagaagcttggcagaatggggtgcagaagatctggaatccaaccactgattcgctataacttttcacaagacgataaaactcacatttccttctctaaataaatactggattggctgacattaaggatcaatgtgctgcctagattctttgttatttgtaaatcaagtaccacaagtggaaaagtattcaagtaacacatgtgacagatcctgtgctgctccgcttcagaagacagtggggaaggataagattgcattccttaaagaggccccattcatcactggagctatagatccttgtatacagagtgaaaagagggaaaacactgtcaaaatgatttagtaatagttttcctgactccacagttaaactacagttcacctcatacactcacattaggtccgaataattggcagactggttttaagacaatactcctagttctaagagttgttcgtcattgcccacacaattcagaatcttaaaagatttgtgttactctgcaattaagagaaaatattgtgtgtattcttttgaatgtgaaagtaaatatcagataggaagtgttagtagttagtggttggataaaagagtcctcgcactggtcattcattcatttacccaaaatttattaaacacaaacattggtgctagagatacaagggtgacgaaaacatgatctttcctccaaaaaattaagtctgatgagatgcattttctagaaacacaaaatacttttgaactgaaccttggaaaaagtaaaaacttgacctttcaatagataaatatttggctttaggaaaaaggtatcttaattctacatcagaactaaggtagtgcactaaaatgaaagggagcaatgttaattcttctacttttaatgtgatttaaataagagaaaatacaggaatgtcttttataatttgaaattccagagaaaatgaataaaaaagcaattaaaaaaaacacctcaacatgcttctcattttcagccaagtacagcaaactctgtttgatattctctgattttaaccttggatcaaactatttggcaaattgctaatttgaacaggctattgaaaacagacagtgtatctagcaattcattcattcattcaatacttaatgaacagcattttggcaattcaaagcctgttccttgtattgaactatattggtgtattatccatatggcctagagtacatgtgtattattcatattatccatattggtgtattatccatagggcctagagtacgtggcttctgcccccaaatgtcttacaagcatgttaaagtacccaaaatccatccaactgaaataatttgacccatacattatcaaggttcaagatgtgtgataagccatgaaaaggttggtgaatagcctagggtgcatatggtgagtgaagatggatggaagaaattaggagtccagatttattggggagactttatgaaagcaaggaatcatgattgttgcaaaatagacagtgaagaaagaaatggtgtggtggtgaaagtcttcccaaagtcatttaaagtattggcaacccagatacttggcagcaggagtgataattgatgttacaggaatcctatgtaaacttttgcacattttaatgaagattttctataatatgctgtctggtgacttctcccaatcactgtcaagggctagacttcattattttaagatgtctttcattcatttattcactcactcattcttttttttaagcaaaatttattaagacctgtaacatacttagcactgatgtaagctctgatacagtcattcagtaatgtcagcctgagcatttgcagaaccctgaatatggatcctcatttttcccttggggtcacccgaagtcttaccccgttctgtgtttacagtgtgaaccttattcttataaggaatattttttgtttcttattgtggattgtctgtacttccatcagatgtgactcagcttcagtttttctgattacctgtgttattttccaacatgttgcaagtgataagatcagtattatcaggtccctaatagcataacaggttcgtgtgaattagatatattaaaatgagaagatttttaagtcattttttagtcaattacgtgtatagaaacatagttatacttatctcagaaagattccaattcaaaggataggaaattagaaaaacatgtaatgtttcttctgagaacaaatatattcaaattttaatgacaaagatattaggattatttttctagtaatttgatatacctgataaattaaaataagaaatcatcaaccttcaagcaccttataatatataatctttgatttaacttttttggacaaattaaaaaataattctctaactcaaagcaggcagaagtatctaatatttatgcttccatcattagtatttttaaagtacaagagacaaaagcatttttaatctcatgtatatcatacatcaatattttttaagtcatcagcatcactatgctaaggaaatattttatataaagaaaattattttcataaaataaagaaaccatctttctagagaaaatccacataatcctatgcccaaatataaatataacatttacagtactgactacagcatccatcttattctagtttaacatacttcagtgtgcattttatcatgtgcttacctcatcctttttataaagtatctcttatcagctcaaccatttcctaatgttatgcactaatggtaataacattgtaacaggtccgagaatgctgtggcccaaactactctgattcctgtgtggcactcacacctggccctgcatcatttctagagcattttaagaccaggttaaagactgggatcccttcatgtatgctgatcccaagaatggaccgacctggctaaagtttattgcatttcaagatataaaacaacttctattatatttttcttttggtgatatttgatttaacctaaaggaaaacaaaagaacaactaaatattcatttctgcctgtactaacagggcaggtaagagtgccagagtaacaagtagtttccaaatgcacaatgaaacacaggagtgcattggccaaagagaatgcaaaatatcagctcttgctatatagctaacaatgtgctgctctttttggaattagaaaattatagaatatatttaataacaatctggtatatgttttcatgtcaatgaaaagtggataaatttagatggttgctgtttatgtgcatttgatcaaatcttttctgaatttgacatgaaaatacacttgtgcagctttcattggttgggtcacaattttagaataaaacaaactatttgaaaaccatttgcaaactaatgtacaaaagcaagatcgcagatgattatatgactctggcagcttacataagctttctgcaggattttctttcagaatctctatacataggctcaaacagaagttatttccgttgttagcaccatattttaaagaaaaaaaatactatggtgttgtatctaatcttgtgacccctgacctttaccaaagcggattggcattatgtttaagttcttaaattacagatcaagaaaatgcatacagaagatggggggggggcacacctaattaatttttatatttagattaaagaaaataattaaatgtgtttttttgtgggattgattttcagaagctaaatgcaactagttcatctgaaggcagcacggttgatattggagctcccgccgagggagaacagcctgaggttgaacctgaggaatcccttgaacctgaagcctgttttacagaaggtaagcaaaacaataacatatgtggtcttgagtatcctcttttctacccattttttcctatttatttaaatgtctgtttatttgtctaccatctattatctatctatctgtatctatctatctatctatctatctagtaatcatctatacctatccaacaactgtacatttatttgtttttttttgcatttgctgtttgaaaaaaaatgcaactttttaaaaggcaaagtttaatttatgtaattagatattttcatttttatgaatcatttttaactctaagaaattattaactggcttttctgtggccttctaaaatatcttacaggagagaaagccaaatcacacacatctctctttagtttaaaaattcaataaataagaaagtgagagaagtaatttattatgtactattttgtgatattataatgggtaataattgataagtgtacatttaaatttgtccttgactgaaacagctcctatttcagtcaaggtcaaatattttttattatttctgaaaaaagatagatcataaaaatgccaaaatatactatgagtcatatgatatggggcaatatgtcactggagtaatcgcaaaaggattttctgaagaaagctaaaattatgtaatttgaggtatggatcagttatatattgtaatagcaatgctgtgtatcaaaccaccaaaaaccctgggctctaagctgcttttctagttttgactcctatttccttctgtgtaactcacagactttcttgtcactaagttttacttgtatcattgtttctctattcttacagcttcattttctacatatgtctcttatatatccttcaagatctagtctcaaatccatttcctccataaagctcagaaattaaagtttaccagaaaactctcataatactttgttttgtgataattgttgctttccataactatagaattgtagacaaattgccccaacttaaaatgtacattctttgaggacaaggctatgttttacatgttatagtattacaatttgttctatgcaattttttgacaatagtagatactcaataagtatttgttgaagagcctttgatctagcaatccagaaattatacaaaggtgtttattggattgttattgataatggccagatttaaagcaaacgaagtattcaataatggtggaattgggctgggcacagtggctcacacctgtaatcccagcactttgggaggccgaggcaggcggatcacttgaggtcaggagttcaagaccagccaggcaaacatggtaagaccccatctctaccgggcgtagtggtatgtgcctgtaataccagctacttgggaggctgaggcaggagaatcgcttgaacctgggagacagaggctgcagtgcatgagccgaggtcaggccactgcactccagcccggacaatagagtgagactccctctcaaaaaaaaaaaaaaaaggtggaatagttatattaattatagtaatcatatttagagaaatattatgaaatctttcacaaatttatttacttataataaagatgggaaatagttataccattaagtgaactaatcagaattcaaatatgtaaagtgtccatatagagtggaattacactcataggataaggacaggatggaaataccaacttttggtaagtttattttctttttggttcttctattttttatatattgtgtttttgtaatgtaatccattatagtagtgctataaacataaaaataaatatttattaaacaaatgattaaaaagccatatagatgattttaagatagcttttgtaagcggaagctatcttaaaaattaatgttatttacaatgtattatcaggtaataatgtaaatgaatctcccaccaacacaaatatacctaatcaaagagtaattttttgtcttcatttttttcccacatattttagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggtaggtgatgcatgatccactccttcacctttcatctgaaatcttttccctttcccttcaatcaactcatattacccacttttaaattaaggtgtttgtaagaatgagaagaaatatgtgtgacgtgtttagcacatatgagaggcttagtaaatagcaatttttgtcactctgtctggagtagccctcgggtggaaccaaactcagatcattatggtttcttataatgtttaaagaaggatctttctgactttcagtcatcagaggcagttcttattaagactggttatgtagacatgatgtaggattatcagctaaatatcagactgaagcacgatatttccctgacccctttgcaggtgagaactagagtgcatgggtgccggtaggagcgaactccactcactcactgctccacccctcacaggagggggagcgcaggtgactgggtgcaggagccaaggcaaatgcatttgggcactgcaagagtgaactccataccggccccacaggagcgtctaggggagggtgcctgcgatccttgaagccctagaggaagtgttacagtgcccttttagctttgccatccatggatggcttaaatgttaacagttcagtggagggtcagagtgacagccttttgcacccacacttgtggtacccaagttcatgtccggcgtccaggaggaatgagtttgtacaaatgacttgaagatggtaaatacaggggattttattgccagcgaaagtggctctcagagggaagaggagctgaaaggagatggagcaggaaggtaatcttcccctggagtctggccatccccagccagactcctctccgaagctatgctgtcaagctgtccctctgatgtcaagctacttctctctaatgtccaactgtagtctctgatgtccagctgttcctcctgtctgcctgctgagttctgggctttatataggcacaggatgggggcagggtgcaccatgggtggttttggaaaaggcaacatttaagtgagaaaacagggatgtatattctcactttgggccacggttccaggcttgagggtggagccctcgccaggtacccgtcctcttctgcccagaatttctctgcctcttgttcctgtcaaaattgcttaacataaactccatgctgcaggggactcctctgtcttcttcacactgattcgctattgccaaccacagtgaatgataagaagtagactcacttaattactgactagcaaaaaaatgatggcattacaaacttatgtctgatttcattcaatgaaatgatcaactggatcaaaatattaatataatgaaaatgatatgacctattttcttaattggtgatacaaatgtggttgcattccttttactgtttcaatttaattaataactagagtgtttggtgagttgatttcattaggagaattactgcattggatctggaggcctctaaggcgaattctgatttgactaagaatcctgtgtcctgccatatactcagtttaaagaggatcagccatgctttattttctttacctttattattattattattattttttagacagtcttgctgttgcccaggctggagtgcagtggtgtgatctcgactcactgcagcctccatctcttgggttcatgccattcttgtgccttaacctcgcaagtagctgggattacaggtgtgagctaccacacctggctaatttttgtacttttagtaatagagactgggttttgccatcttggccaggctggtctcgaactcctggcctcaagagatctgcccgtcttggcctcttaaagtgctggaacgacgggcgtgaaccaccgcaccttgccagacatgctttctaaagccaagtagagagagaactatgaagtctcattagtgactagtacctttgctgtaggagctctttgttctcagttacacccagtcagtgctcaccaaattgcacaacgtgctggcacagtggctggctcctcaggggtttacagcttcagctataagcaaagcccagaaacctttaggtccttgtatggagctctggttacaagccctgattcttgttatctaaaaaagaaaatgttcctttgtctttaatccaggctgccaggttttcctgataatttttccgataagaagatcaagttagataaatagtcttttcattctggaagcctcaggagttcctgcaaatgagttacccactctttcccaagggctctggaaaattctgtcaaagggaatttccaaacgtacacccacccgcctccacacacacacagacacacagagagagggagagagacaagaaagtgagcaatgacaatcctttcctttttctgtaggctgagggacctccctgctttatatctgcattactagaggatgcattccattgagtctgcactgaatgagaccaatctactcccaggcgttccactgcctcctgatgtagagagaagcagctggcagtctctcaaaaattttaagctctttgggggtacactgagaccaaaatttaaaaattactgaaacccttggttgactgaaatgcccagtcagcagtcatttatgatcagataatgataaagtaaaattcagccatgggaaacattaaaccttccagccttaggcacctgataagagcttgcatcgtttccttttttaagaaatcatcaattagagactgtttctgatcataaaatttaatagaattttttgacttacaggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtgagtatgctgcactttgctgctttattcattggcatatatgtaatagttctagcaatggtgcctgacacagtgtaggcactcagtaacactgtatcagcccaaatataaattatgtttctcatttcacagtgagaggatgcctcaaaacattttttaccaatttaaatacatatacattcatagataaaaatcaaatgccatcatactatacttattcacttaatttcaaattaatatttaaaatctcaagttatgcaaaataaaatatgaatttagaaattttgctttttgcacactcacatttcgcaaaataacttgtatttaaatttttcacaggcatctttgacattagtatgtttgtcatcactaaagcctgttgagtttaggtcacacagatgaatcattaattacaaagaaatttgaaagtccaaaaagcaagagacaccacttgatttgtatgatatagaagcaaattggctattgaccaagtagccaaagattttattaaaccacattggtgttgaaataaaataagatagagtactaaaatatgagggtttttatataattgaatatgaggcaaatctaccattaaatgtactactactattaaatgtataaaggttacatgcagaattacattaacagtctctggcaataaaggaagacaataaataatatttagaactacataagtgtggacattacaaacaatagaaaatgcaccaaaactataaccattcttttatttgtataatgggattatgcatgatactatttcttttctctattttctgtatgtacttatcataggttggtaaatccataataaaaatatctgatacttgatatatctatgttaggataaaagtatcaagtcagcactgcttgaatataaggaaactcttcagagaaatctagttgtcctgcagctaatgatcatattacccaaagtactctgatatttacctttttagatttaagaaaactattatgatagtatatgaaactgatcaacactttgccttaaatcaaatatgcttattgctcatctatttcattatgaaagatacaaatataaataagtcatttttctagtcctgcagtagcttacagttgaaaagtgaggacagctgcgtacacagtaagtcgacacctgtattacaagtgccacctctttacttgaggaaggaggaaaggcttcaatagggaagtggagtgtgagctggagcttgagagatgtgaatgctagcaggcacagctgagggaggaacacggattcgttaaaacgttggtgcatgacatgcagggcgggttccagaaacaagtagatagggtgaggtaagcctttgtaatgggatgataaggtaagaaagataagttagaaaagatctgaagaacctgagatgccatccaaggaaatttggacttattatttaatacagaggaagctattgaagaattacatatagggaagtgacaagacctgcttgttcttttagtgagggaagttaggtggaggtgagaatgacggaatagaaaggagatttatttagagatcaaaacaccaattaggagattgctgcaatgtcccagaaagagaaggcctatatgtatcttcttttccacatttagctacacaagtcacataaaactgaatattttacaacttcttttcagccagtaaatactaccccattcaaaatattttcctctgtctaacttttatctttcatcctttaacttatgcttatctctttttggttctgtcttcagagaaggtaaagtactacaggtccttatatcttaaatacagaaaagcttcacaactcatgataattcagtaactatttttcaattatctgttaaaaagggacttacaaagcctaagagtttggattttaagggaactatatgaactatgtaagacataattttacaactcattgttttctgtattcaagaggcttcactttcaaattgcatgtgcaaaattattttgaataagttgttttttgtaacaactttcaatgtgcttcacttattttccttaaaaaatatatttttcaaatatattaacaccatactcttaaaagctgtattgcatatttatttttatttatctgcttttgaaattcaggtgtactttagaacaaaatagcttatataattttaataatttttctatatgttttcaaggaaattggacatgtgtatgtcccccgaccgtttttctttttctttttagctaagactttataatttttctcaactacattagtcaactgtatgaataactaaagacaacattgttcttgcaatttctaatttatcataaaatctcaactttttttattcactaattttgtctgacctaattaatgatattatgcccttcaaactgaaatttacaaaagtcaaagctgctttttagaggcctattcctttttaaatgtgttcatgctcatattcaccagtggtttgtatagtttacttgtgtatcaaatgttactttccatttcagatctgctcaatattattagaaatgatacagaaataagttttacagatctgtagaggaagatcacatttctctctcttttttttctttacttttaattttttaaaaacatttcctaccaagaatcttgaaaaagagcacatatatgggcttcttttttataagtgttcgcagactagtatcattaacttcaccctgggaacctgtagaaatgcaaattcttaggcctttccccaaacttactaagtcagactctgctattggtgtttttaacaagacccctgggtgattttgaaactcatgaaagttcgagaattactgattcattgcatagagcaaggctgaactgtgtagacatttttatatgtaaataagaaaattgtgttgctttttctgtataggtctcactggttagcttaactgcaaatgccttgggttactcagaacttggtgccatcaaatccctcagaacactaagagctctgaggccactgagagctttgtcccggtttgaaggaatgagggtaagactgaatgccttagagtttgtcagaattattattgagagcagactgacactttgtaccatggaaatgtcaaatttatggagaatttgtgtcttacacattcatactgacatagctaatcaatcaaaaataatatttaccagatgcccataatacttggcactgctggagtcactcacagagtagtatattgccagagggattgtttctgattagctagattttcacttcttggaaaatctctatagttatgctgctgatttgaatcaagattatttatgttcacttcatttataaatgtgcaggaaatcctactcgctgtagtttaagcctaccaaatcattgctcatcatttcttcactactccgctgtgatacactttgagccttttgatgtttgaatcaggccttttagttcttaaacacaggctgaaatggctaaaaagtaggtcaactggaaatctaacgctcatttagaagggtggtacaaaagaacagaggagtttgtgctgacatttgtcgtcccctgaggcacaaaacctgagaccacataccctcaccacctagaaaatgatgatgccttgtctcagttgttttagctggttcaaagaggattttaaaaaaatgatactttttgtgatatttgaaaataagttgcttagactttatctgcatgttatagtgatactagctcatattttctaactaagaaaatagttacttagactttatctagtgttacaatcacaactagagatgaatggtgtgtgtagatgtgtgtctgtatatgcatggttacatagaaaagtgttattagcggtaaaattctttttactttaccaattagaaagaacagtttttgcagtagaaggcttaataaacaaaaggtatcaatctttcagtaccagaatactgtttatattttctgtgtggaatttgatccccaagtggtctcttttactctcaaattttggacagcaaattgtatggtttgtatgattttttgaaagtgatgttcacttctatattcatgccactgtttatactcttaattatttttggcatttgctgttagttccatcctttgaggtaaatttgctacatgtgtgttattacctcttgagaaaacattctccaatataaaattcgttgtatactcttctgatttataattttaaaattcttagttggagctaccagagtctagtttctacccaatattcaactttgaaacagatttttttaatcatttgactgttcttttaataatgtttaaaaataagtaaatatttgttgttggcttttcacttatttttccttctcatcctgtgccaggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagtaagtaatcactttattattttccatgatgtgtaattaaaatgagtctaaagtttttcttcctcataatgagatatccacctgttagaatggctattatcaaacagataaatgacaataaatgctggcaagaatgtgaagaaaagggaacccttgtacattgttggcagggatgtaaattagtatagcttttatggaaaacagtatggaggtttctcaaaaaactaaaaatagaaccactatgtgatccaacaattccattactgggtatatatacaaaggaaattaaatcaacatgtcaaagagatgtctgcactctcacactcactgcagcactattcacaatagccaaaatatggaaacaacctaattgtccatcaacagatatgtggataaagaaaagtgtgtgtgtgtgtgtgtgtgtgtacatatatgtatatgtatatatatacacacacgtatttctatatacacacgtatagatatacactgtatatgtatatatctatacacatatatagacatacacagaaacagtgtttgtgtatgtgtgcgtgtatatagaagtagtcagggaaggggcagagcctgtggcactaagaaactgagaaaatgtacaagacttttgttttcagaattactatgtccgcacaacagaaaaagtatttcaaaaagtaaatgcgcttgaatgtatttgttttcagtttaggaaactgcttctttttgtagagtgccttaaaatagtatgttcaacaatattaaaaagattttcaaaaataagccctcgtgattgatgattggtaataatcatttaaaaacttattggatgtatatatatgtgtgtgtatacacgcacacacacacacacacacccctatagacatacacaatgaaatagtattcagcctttaaagaagaaggaaatcctgtccttttatacaacattgattcacctggaggaaattaagtgaaataagccaggcacagaaagacaaatgacacatgatgtcacttatatatggaatctaaaaaacacaaactcacagaaacagaaagcagaatgacaatcaccaggggctgggggatgatgggagatgttggtcaaaggatacaaaattcaattcgacaggaagaatacattctgtagagctattgtacagcatggtgactatagttaataataatatattatatacttgaaaatagctaagtgagtagatatgttttctcatcagaaaaaaataagtataagaagcgataattatatattacttagcttgagttagccatttcacaatatatatatatttgaaaacatcattttgtacaacataaatatattcatttttatttgtcaattaaaaaatgaatatatttttgaaaagcaattaaaataaaaatgcatatacattttaggaactctatatagatgcactaaaactatataaaaatgatataatactatacaacaataaaataaaatttttcttcctctgtgtttacaaatacttccttaggcccatctgcctagattcctcttaccatgattgaactatcttttctgccccacgctggaaacatgatggttctaaaaactttattgtctccctgactatgcatttggtagcatagccaagtcctttgttactgggagtttaatctaggcactcattgttttcctcccttcctactctgaggaaagaagtgctggccccaaggggggttgaaaaggggtgtgtgtgtgtgtgtgtatgtgtccacacgcgtgtgtgtagatagagaaagagagagagactttcaaataggaaaattgctctcttgcaaatgaaaactttccaattaagactattgtgtctgctatgcactcataataattcattcagctattcaactgactgcagtattaaatctccactagctcctggacacaatccacttacacgatcctcaagactattaaaatagtcaggaaaggggaagagcctgtggcactaaggaactgaaaaaatgtacaagagttttattttcaagatcattatgtcaacggagcagaaaacaaatatttaaaaaaggaaatgcagtagaatatattgttttcagattaggaaactgcttcctcttatagagtaatcacctcaaaatagtatgatcaacaatattaagaagattttcaagaataagctgtcatgattggtgattggtgtaataatcatttagaaaagaataagtagaaaggaagcattaagataaataatgcagcatacttttgagcttgtctcatgctgctactatacacatgaaattttttcatcaaagttcatgatatatttttatataaacacatcagagtcaaagattgttcatattgtttttatgatagcatattgttacagtagatcattatttaattatatatgctaaatatccacataagatgttatagaggaatataaatttgaagtattttcaatgcatatcgcaaaacattgccccaaaagtgaatacaaatttcaagcttatttatatgcctgtattgaatacatgtcaaatagaattttgatcaattattcaatttattttctaaaattataattttgggaaaaaagaaaatgatatgacttttcttacaggccacgtttaagggatggatggatattatgtatgcagctgttgattcacgaaatgtaagtctagttagagggaaattgtttagtttgattaaatgtatatttctacaatattgtaatttagtgatattgtcaataaaataaaattatgtgcttaatttataaaacccatctatattataaggataaaatatttaatcatactatttctttcaaaattatcataggatgattttctctaatcactctgtatcttttaacatatcttttctagtatttagcaaggcacctgacacaaaactttattgtatgtattttcaaaatgagacattttatttttggctctgatagtcctggtcatttgtgcattagaagttctcacaggcaatattttttatctgtaatatatttcctccagcttttgatcttccttataataggaaggatatgactaaaaacggggacaaaaataaacaatttagtgtttctcttgggaaagtgagattaagtggtagaagggagggacttccctaatctactttatacataccagtactttgaattcttttctataattttcattaatttctcactatttaatgaggaatgaagtcacattttgaaaaaaaaaaaaaaagagattgatttctggtatgccagagcatgataataaagctcaaaatgctctttccctagcaccagcagctagctttctgagtgaagaattcctgaggtttttttttttcttttttccacttcataaaaacagagagggagcaagaaagcatgaaaagccctgcattgtatctctataagtgctatcaggaattccagttatgagatttttctgaatagtaataataatttattgattatcactattcactgtgccaaggactttctcacattatcccatttaatcctaaatgacaaccttattgtataggtgatactagctctattttactactgaagcaaagaggcttaatgcgttaaatgggaaaacaagtttttgaaccctgaccacaaataatggctcatacccactttccacagtggttcttacctttttgattaattaattcaatgctctctccaccttccttatcaatagcttatatgccatgaaacattttcagtttcttctttaataacttagcagaccttttccgctgcaaaactcctggaatttccagcacattacaaaagatgaaagccaattgagcactacatttatgaaaagttgctggatcttgaactttaattagtaaattgcatcagataaatgcaaatttaaaccaaaataaaacattatctacacacctaccagattggcaataccaaaaagtctgacaataccaagttttaccaaggataaacagcaataagaacactcgtacaatgctgataggaaaaaaaatagttaaataatcctttaaaaacagttgggtatgatcacattatttgagaaagttaaagatattttttaatactgcaattctactttgaacaacgtatcctaaagaaacttatgcacatgtttaggataatctatgtacaaaaatgaatataacttttttttgcacttgcaaaaaactgggagcaactcaaaaacagtagaaataggcaaataattgaatactatatagtgatgaaaatgaatgaataccgccatatacaaccacatggatgagccttaaaaatacaacattgagttaaagaaactagacacatactataattctacttatataaagttcgaaattgacaaaactaagcttattgttcaaaactgcatactgaggtgttaacttgaaagaaaaagcagggacatcattaccataaaagtcaggataatgattacctccagcagggatgatggagtttatgtttgagaagggtacaccaagggtttctgaagttgtagcaatgtcctgggttatggatttcacttataaaacatattatattttgcatttatgtattatgcactttcctgtatgtatattgtcttttaaaaattttaaaaatataattttacatcactgttaactaaactcacatacacaaataaaatctcatcgaagaatagcagttttacaatattcctgatattttccattttgctgtatttccttagaaacaaaattatgctggtcataatcctctaaattgatttcataacacagtgggttataacttgcatctattatcatcatcagggattggttaactgagttggttagaacaatgtcctattagacctgtgaaagcttacagctaaggcgcaaacctactatcacacagttttctaaacaaaagtggattagacaagagatagtatcattgttacagaaacagtccctactgaataggataaagcaatagattcattttcagaaaggaaagatcaacctatatacctacatgcagacctactacaatgattcttgcctatctaaagaaatgtattataccaaacccttacacttagcaattactactggccgccactgttctaagcatatttatatgttaatatagttaatcttcacaaccacactatgaggtttaagtttgattattttcatctcacagatgagaaaactgagtcagagaaagtaaatcttaaaagttttgacatagaataatgtgacgctgacatctcttttgtaagaagaggaaatctttaatttgcatgctgtgttgggaactttgcttagaaaggaaagtgcattcataatctgggcatttgttgggtgaaattgtctataatcattcagacttctatatggttatttcattttcccaggtaatgaatagtcttgcagaactcttcaataagcatgtgagatttgaaggttcataaaatctgtttagtgtttggtttattttcattccagagattaaaacatgcttagataattaaaaactcactgatgtactttttgtgaaacaagtactagatataatggttacaattcttcatattctttaggtagaattacaacccaagtatgaagacaacctgtacatgtatctttattttgtcatctttattatttttggttcattctttaccttgaatcttttcattggtgtcatcatagataacttcaaccaacagaaaaagaagataagtatattaaaacttcatccttgctctgaaatatgaactaaatatttcatactctttcctttagcctccaaaatgcaatcaccaaaaaaagaatataaaattcagaaattattttgagacatttgataatcgataagcttttaagcaattaataattcagatagcatgtttttgatatttttagtctagaaatatgactaatatggcataatttatatattgaataaaggcatctctataaatacagatattagtaacaatagaatgaaatgtgggagccaattttcacatgattactaaggtggattttatagccagcaaagaacacaattttaacaagtgttgctttcatttctttactttggaggtcaagacatttttatgacagaagaacagaagaaatactacaatgcaatgaaaaaactgggttcaaagaaaccacaaaaacccatacctcgacctgctgtaagaataacatattttcattgcctgttaaaactatattacctaaccgtttcacagcccgaatttctagaaactagttatttttgtggatttgtaacacaaagttttttaccttaacaatgggactagctagcctaaatagcttgaaaaatgtactttacatatataatatgtataaattatataatgcataacatattttatatgtaaacatataaaatacatagaaataaaatttgctatacttaagtgccagtggtatcatacaagctgatgtcattaagacacttctaataacatcaaaaataaaatacatacatacataatgtgaaaatattaaatgttctcagagtacagaggagacagatcggaataattggtacgtcacagattggcctcagtttttgtccaactctgcagattgaatggaatcattaatgaaacaggccacaggttttgcttttttctggttaaacaaaaaaaagacaaacctcatattttcccctactatcccacccttaaatgagatgatatcattctttgtagggctttttattggctcttccaggtgtacatttgccagtgatactgttcgttcagtttggctgctgcagggagttgctgccaggagaatcgctaagtttttctatcactcctgaaggactagctcatatattaagtctcagaaaatcttccccaacgtatacgtggtataaaacacttcagtgtttctcagaaatcttgactctataaatctattggtgacaatataaaacagaccgtaattaagtgttcagttggtaagccggccaataactcaaagaaaatggatagctatattgggtcaaacacaaagggtgtacaacttgagcctagtctttaggaaataatacaatttgaatgaatagagagagaagcagagaacatttactgtatgagaaaatgtatacttcatagccatatagacaaatatatcagtgcagaatagtgatgcatttgaattagtgagtagtagacactggttttccgagttacatgagacaaggttaccatacgagtctgaagaaatttgttctaattaagcaatacaaatgcaatatagttaacagaacagcctagtaatgtgaaaagaaagattttagagagtttaacctagagactggtgtggaacaatattagaggcaaaataaccctcggccatagacaagaagataaacccttacatacaagaagatagtccataatctgtgtccaaccagcaggactggaactactccaggagtgaagttagccaataagaagactcaattgggatgaaacacaggaaaagagggaggatgcaatgaaaaaactgggttcaaagaaaccacaataacccatacctcgacctgctgtaagaatagcatattttcattgcctgttatgaaacacaggaaaagagggaggatatgtaaataacagagaatctaaaatataagctagttgatattttgtgaaactgttggttccactatcatatactgaagtcatatgaaggcactgggaaaaatagtgttagagcctatgaaatgtccagactgaaataaggattttagcattgtcagaacaaaattcaattgagctctgaaacacagattcatttttgaaaaataattagaatagagaaaaaaacaaaattctcagaatgaggccttgcatacttcatcaagatataggaagaaataaatcaatgaagaaatgagcttgagtttgtttccatcaaatgacatggatttacctgtagtggtaggggtgtgtggaaaaagttcaacacattcagctagaatattatcagtgtcaatttggcaatttagcaagtaactagtaaaatccatttattcctgcattgacaatatgtactatgtagtatgctaagcatttgaacttaaatatcgaacagtatggagtctagttaatgcaacggatagtaatcaaatagtcctgccaaaaaatggaagtatcccagaaaaaaagggatactttcagctgtgagagctgattagggggaaggggctgattaatcagggaagttagggaaggctttattaaaaaaatatactagctgaggatggaaaaagaatagaaagcatcaatagccagagtgggatgagaagagccctgtagaaggggaatgaatttgtgaaggtccttatgtaggagggctggtgagactggagtgcagaaagtcaaggttcatttgggacacactgagaataaagaggttaggataagcccaaacttttctgggccttggaggccgtgttaaggagtagttttcatcctaagagcagtaagaaaccgttaacgtggacccagtcagtctgggctttgtggtgatcactcaatcagtttcacagaggccgtgtgaatacattgtagacttgttttggagctatttcagagatggtaggtagcctgaaccatagcaatgtgcagattaataaaagtggatggatttgtgagctatcaccagagtgaaatttaaaagtttgtctattaattgaatatgggaactaaagaaggaaccaacaagaatgactggtgtctttctgctttgcacaactggataaatactgatgtcatgcaggaaatgaagaagggacagaaagtggtgagaaaattggagatgctagtttgcagaatttggcaaacgagtcagagtgagagagtgagaggaaggaggaagggagagaaatgatgaatatttagaagtagcaaaataaaggtttcttaagattcagagattaggtttaaaggaaagcaaaaggaattttagagaggaaaagatcgaagacagagggaataattacggcataaaaatgcacaagatgtgggacaaggacatagtggtctagggtagctttagaaagaaaaaggggctgagtcctctaatgaatttggagtaatatatgaaaagaacatggaaattaaaataatatgaaatgcaaaaggaaacagaggagtttatttaaactgtttaaatttaatgttctaaaaaaagtaaaaatagagggcaagagaatggaaatttatgagaagtttggaattatctttggagcaaatgaaggacaaaggattgctaattgttaaatctgaagggccaagatgaagttagagaacataaatttttggtgaataagatcttcagaattatacatcttgttccagcatatttgacaccctaggatttaaatgggagaacagaacacagagactcgagactggagttgtacattgagatgtctgtctcattggacaactctatgaacagggaatctaaacagttttttattagtcatggtgatattaaaattaagaccaaatttctgcttttaagatattttgaacttactatactctaggagccatatctgagagaaaaatgatactgctcctgcttttgaggggcctcaaaacaagtggaagggaaagaaaactaaaattgaataagagcaaaccatttgcaatacaatgccatacattttatgatcaatgaaagcactcagttttctgagagcactaagtgctttaaactcaaaactgagttagaattcatgagacagagaaggagtgggggacatgtgttttagacagaatagtagacagataaactatgtaaaatgatacagtagaacctgcctaagcttctaagagtggtaggcaggaaatatcagagggtggaagtaaggggaagatgccagacttggaaagttaaactacagtaaattaataattaataaggaagggtttgaactaaaagtagacacatttattgggttgaaaaaggccctgagaagacagatccagctggagtaatagaaatctagttcagcaggccaaatacgcattcagagaaaagagcaaaacaaaatagaacaagtagtgtttgatgtccaaaaatcaccattggaagtaatagaagcctcccaatagaaagagggcagaacactaagatgtagaatccaggccactaaaagtgtcaggatctgggaaagcaagccattaggtgtatatgtagcagagtattagtcattctagttgagaaggtagagaaaggcagcccaacagaggttaagtcaagaccagatccctagattacctgagaaacaaagcagatacgtgcaaaatggaacaatacagaaaccaatgatcagaactggtttacaagttggggacttcatttcataagcaagacataaggcaattagtacttggaaataaggtccaaatagactagggcaaagattgaatatttccattgtgactttttaaaagataattttattcttacagaagagttactcataatgaatactctaatgaatctatacacagtgtcctcttgttttaacatcttatgcaaccatagatcagttctcacaactaagaaattaatcttgatataataccattaaataaaatacagaactgagtcagatttcaccagtttttccactgaagccttttctctagaatgatgatttttaaaacatcttagctgaactttaaaatgaaatttaagatgctgtagctttagtgagagaatataaagtcagaaatcagacgaaaaatttaaaaagagagaggaaaacttggagaagtatttatttattagttgcttaaagtaaaattaataccctcccaacacatgggataaaaaattttattacatgacaaatatttactaactgtccgtcataacatgatggtgttctgtgcactgagaacataatacgtgagtttataaaacctggtatcaatgtgagtataaataaaacaaatacatttgaatacagttgaatatacaatatacaaaattttcttccaagtataaaacgaaaataaaatacactactttctttaatagaatagaacattgtaataatgttccattgcatttgaccctcacataaatgctatgaggtagcattaagagataagatttgaggctgggcatggtggctcatgcctgtaattccagcactttgggaggtcgaggtgggcagatcattaggtcaggagtttgagaccagcctgaccaatacggtgaaatcccgtctctactaaaattacaaaaagtagtcgggcatggtggcatgtacctgtaatcccagctactcaggaggctgaggcaggagtatcgcttgaacccgggaggcagaggttgcagtgagccaagatcgtgccactgcactccaacctgtgcaacagagcgagactccatctcaaaaaataaaaaaaattaaaaaaaagagagagagataagatttgagatctgacatggagcttccctatttacactacttacctgctttgtgacctaaggcaagttacctcagctctccaatcactggttttgcaaggaatttttttttttgtaaaatgttgtgaggattaaagatgtgtttttataaaagctacattttttgttgctttcttaaaatcagaagaattgaattcgattttttttaaggtttctaatggaacttttacatattatttgttccagaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggtaagaagaggtgcttttattcagttaaggaatatagtggtaaaaatatgtgttttaaaactttagaggtgtttttcactaatctttctcattcatcccaaactcccaaataaaaatctaatagtccattgttttagttttagtttgccatttctctaattgcatgctgtgcttgaaatgatgagtggaatacaaggaatttatattttcagctttcatttattctcatttaatattttcatctgttctcatctcagaagacaataactgcaactttggtagaatagtcttgtacctggtcatactcctgtggtattgacagttactgctttgaataaacaatcaatccacacacatatatacataaatcatttgaagtagtcacataattcataaatatgacctcttaaataattggaatagtgtatatgtgcagttatatatataataacacatatataagtttcatgttatctttgggtgcagacagttttctgtggtttgcaatatctctttttggaagcagatagtttgtttgaaaatccaaaacagatttgttatcatcaatgatacattaatgttaggatacatacatacattaagtcctaggaatgcaaaagatttattggaaaaaatatatatatacagtgtttatgtataagatattaaatgaggtactggaagtaaatataagaagatttaagagaaggttctacctatttggggaaacagaacattcacatggaggggaaaattatatagcactctttaaactactttctttagtcgaatagaacattgtaacaatgttccactgcatttgattctcacataagtgctatgaggtagcattaagaggtaagatttgagatctgacctggagcttccctatttacactacttaccttctcagtgacctaagagaagttacctcagctctccaatctctggttttgcaaggaatttttctgtaaaatgttattgtgaggattaaatcagattatgtatatatatgcacttagcactgtgcctagcatgaagaaaagacttagtaaatgttcagtttgaccacaagaaaaagttgatattatcaccatttactcatgcataaaagcaagtgccaggattcagtcccaagtacatctgtctccaaagcctatgttttcttctgtacatcacgctgcctactcccaaataacatagaatctcagaaagtaaagaactctcatattcctgacccaaaatcatacacctttagttcttatgcaaatactagaactagtattttggacatataaattaatttctgtacttggccactgtatgcttcatgatgtctttggaccttccagggttgagtcatttttttgatagatgctttccttgaactaggaaaaatggcccttattatcttcatttaatataaagatgtaaatgttataacaccaaacataccagtttcattttgctcaacaaacattgcagattatttgcatatatacatgtacctaactgtcctgttcacattttgtaaaactaatgtacttatgtaaactttcatttgctactattaagtataacaatatttttgttatttgttgattttctacaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaagttgtgcatcttttctccttcctgtccacctattgttctttttttcacttttccatttcaatttcttccttatgtattcttgatctacttttctttatatccttctatcctttccttgcgctctcagtatttttcatttaggatattctccttgtttcttttctgttcaccaaatgtcttgtttattacagcctatagatcacttagatttagatccctaaaatttgctgtcactctgtaaagtgcacatagtatctgcgtatttatttttacaattttctttacaaaaattctaagaaagcttagactgcaacttttcataatatataaacaaaattccaaaatagcacagatttgactttctcatttaattatgaacagtttgggaaatgtttctcaattctgaatgcatattagaactacctgagaagcaaaaaaaaaaaaaaaaaaaaagccagtgcatgggccaagaccaggaccagaccaattgaactcatatctctgggtgagacttaagcatttaattttttgaaggctcgtcattgatactgattcataccaaggactgagaactagcaaatttgggtctcctttgcccaataggaaaacatattctccggaaagtccaaactgtccttcattacataacttatcatgtacagaataaagttcctaagaggatggctttcggagtatttatattgcagattgagggattgacattgatctaattataatagaggttcttctttagggctgtagttggtataaagggaattctattagaaaagtttagggagactgtgttcaggtaacacatgcacacacacacaccccatatggcaccttaactatccctagtgtatactgggtggaatgaatgtgggatggtctaggaaacagtataaatttataaaatagttccctccagtgaatgctacatgccctgttgcatgagaacctttaatctggaccaatagaaggcagttcatggtggccagtcagaaagccattcaatttgtcattaccaactcacaaatctagacaggaaagattctcattctcatcttctccattcttggcgcatctcacacaatcccttgtttttctgagctctgtaacatacagacctatttacaaacagaagggaggagacaagagaggtaaggggaagtaaagaaagaggagaaaggaggagagggaacgataggggaaagtaggagaaaggaggggagtgtaagaaatgggatgtttcatgaattataattctgaaaaaatgtctggtgtggatacctccagcaatggtgagggaaggaggaagaaatgttgcttagttgtcaatatgttagatctaaaatataaacatgtttcttctcttatttatttttatttgtatttatttatttatttatttttgagataaggtcttgctctgtcacccaggctgaagagcagtggtgtgatcatggctcactgcagccttaaccttctggactcaagtgatcttcccacctcagcctcccgagtatctgggactacaggcatgtgctcccacacccagctcatttttttttttttttttgtattttttgtagagacagggtctccccatgttgcctgggttggtctcagatttctggactgaagcaatcatcctgcctcagctttccaaagtgctagaattacaggcatgagccattgcacctgcccctctcatttttttaaagaaaagatacctgtgaaaaaagtgaagaggacattatacaagaaaatgttacaatgattccatggattcaggaatatttttttttcttttacctgaactaaatacatatttgagtgtctactatatatcaactttgcaatagcagctaagagatcaaagaggaatataactatccaaagaaaggctataaccagaggtgaagaacctggaaagccatgctagagtttggaattgattctgtggcaaaaaggagtgattactcctgagaagtagaaggaacagtgaaatatgacacatctgtagctgctgaatctggtagtaataaggctatgctgcccattttttctagtattttacagcaatctcattttcccaattatttaaatgggttcttatctcttggtatagtatatagatttattaagtaaaagaatataactagatttttaagtcatccaatgtgacacttcctgctaatagcctattttaatcaagttacattttttatatttacagatacatctaattttattcctatcactttacttcacactttccactttttgaggtttttccttttattctcctcttccttcttgtcctcttttgctttgtgttttctgtttctctttcccccatctctgatggaaagttacacatcatctccctccattcatccctccctccctcctttccttcctttcttcttttttctttctcttttataagtgattactcttaaattttaacatgcatacttaattaaggtgaactgtaatcaatatttgtgtcctgatctggaaaaatgaattttcctagactgatgacatatcattgctctcctctaatatgttatttttgtgtagtatcttaactctaccttaatttgagataaaacaaattaaacagtattattacatgaatttgtaggcagtacttatttagacttacatactaattattg

SEQ ID NO: 3-6 - skipped (4 entries)

SEQ ID NO: 7 - DNA, 19 bp, synthetic construct
  misc_feature 1..19: note = Primer
  source 1..19: mol_type = other DNA
gaaggtgaaggtcggagtc

SEQ ID NO: 8 - DNA, 20 bp, synthetic construct
  misc_feature 1..20: note = Primer
  source 1..20: mol_type = other DNA
gaagatggtgatgggatttc

SEQ ID NO: 9 - DNA, 20 bp, synthetic construct
  misc_feature 1..20: note = Probe
  source 1..20: mol_type = other DNA
caagcttcccgttctcagcc

SEQ ID NO: 10 - DNA, 20 bp, synthetic construct
  misc_feature 1..20: note = Primer
  source 1..20: mol_type = other DNA
ccttgaacctgaagcctgtt

SEQ ID NO: 11 - DNA, 21 bp, synthetic construct
  misc_feature 1..21: note = Primer
  source 1..21: mol_type = other DNA
cgaaccaattgtgctccacta

SEQ ID NO: 12 - DNA, 24 bp, synthetic construct
  misc_feature 1..24: note = Probe
  source 1..24: mol_type = other DNA
ttccaccagagtttccctttgcct

SEQ ID NO: 13 - DNA, 20 bp, synthetic construct
  misc_feature 1..20: note = Primer
  source 1..20: mol_type = other DNA
ggcaaattcaacggcacagt

SEQ ID NO: 14 - DNA, 20 bp, synthetic construct
  misc_feature 1..20: note = Primer
  source 1..20: mol_type = other DNA
gggtctcgctcctggaagat

SEQ ID NO: 15 - DNA, 27 bp, synthetic construct
  misc_feature 1..27: note = Probe
  source 1..27: mol_type = other DNA
aaggccgagaatgggaagcttgtcatc

SEQ ID NO: 16 - DNA, 20 bp, synthetic construct
  misc_feature 1..20: note = Synthetic oligonucleotide
  source 1..20: mol_type = other DNA
gacatatgtctgaagcagcc

SEQ ID NO: 17 - DNA, 20 bp, synthetic construct
  misc_feature 1..20: note = Synthetic oligonucleotide
  source 1..20: mol_type = other DNA
attgataagctggcaccaag

SEQ ID NO: 18 - DNA, 20 bp, synthetic construct
  misc_feature 1..20: note = Synthetic oligonucleotide
  source 1..20: mol_type = other DNA
gtttgggtctcttagctttc

SEQ ID NO: 19 - DNA, 20 bp, synthetic construct
  misc_feature 1..20: note = Synthetic oligonucleotide
  source 1..20: mol_type = other DNA
actgcaatcctattagcgca

SEQ ID NO: 20 - DNA, 20 bp, synthetic construct
  misc_feature 1..20: note = Synthetic oligonucleotide
  source 1..20: mol_type = other DNA
gtcctattgaaagtagtacc

SEQ ID NO: 21 - DNA, 20 bp, synthetic construct
  misc_feature 1..20: note = Synthetic oligonucleotide
  source 1..20: mol_type = other DNA
ttccgattttcggactctgt

SEQ ID NO: 22 - DNA, 20 bp, synthetic construct
  misc_feature 1..20: note = Synthetic oligonucleotide
  source 1..20: mol_type = other DNA
tcggctgtcattgtcctcaa

SEQ ID NO: 23 - DNA, 20 bp, synthetic construct
  misc_feature 1..20: note = Synthetic oligonucleotide
  source 1..20: mol_type = other DNA
gaacagagagtctcttcggc

SEQ ID NO: 24 - DNA, 20 bp, synthetic construct
  misc_feature 1..20: note = Synthetic oligonucleotide
  source 1..20: mol_type = other DNA
ctttgccttgatgtaggatc

SEQ ID NO: 25 - DNA, 20 bp, synthetic construct
  misc_feature 1..20: note = Synthetic oligonucleotide
  source 1..20: mol_type = other DNA
ctatggtggtatggttggaa

SEQ ID NO: 26 - DNA, 20 bp, synthetic construct
  misc_feature 1..20: note = Synthetic oligonucleotide
  source 1..20: mol_type = other DNA
cctccatatctgactcgctg

SEQ ID NO: 27 - DNA, 20 bp, synthetic construct
  misc_feature 1..20: note = Synthetic oligonucleotide
  source 1..20: mol_type = other DNA
tctccctcggcgggagctcc

SEQ ID NO: 28 - DNA, 20 bp, synthetic construct
  misc_feature 1..20: note = Synthetic oligonucleotide
  source 1..20: mol_type = other DNA
caacacttgaacttccgtac

SEQ ID NO: 29 - DNA, 20 bp, synthetic construct
  misc_feature 1..20: note = Synthetic oligonucleotide
  source 1..20: mol_type = other DNA
gaccacgcttacatcaaaca

SEQ ID NO: 30 - DNA, 20 bp, synthetic construct
  misc_feature 1..20: note = Synthetic oligonucleotide
  source 1..20: mol_type = other DNA
agctttgcactcactgtagt

SEQ ID NO: 31 - DNA, 20 bp, synthetic construct
  misc_feature 1..20: note = Synthetic oligonucleotide
  source 1..20: mol_type = other DNA
tacttgggttgtaattctac

SEQ ID NO: 32 - DNA, 20 bp, synthetic construct
  misc_feature 1..20: note = Synthetic oligonucleotide
  source 1..20: mol_type = other DNA
ttttgcttcaagaggtagcg

SEQ ID NO: 33 - DNA, 20 bp, synthetic construct
  misc_feature 1..20: note = Synthetic oligonucleotide
  source 1..20: mol_type = other DNA
ggtcacactatcatacgagg

SEQ ID NO: 34 - DNA, 20 bp, synthetic construct
  misc_feature 1..20: note = Synthetic oligonucleotide
  source 1..20: mol_type = other DNA
cccatcgatactatttctcc

SEQ ID NO: 35 - DNA, 20 bp, synthetic construct
  misc_feature 1..20: note = Synthetic oligonucleotide
  source 1..20: mol_type = other DNA
gtagccattacgcctctgct

SEQ ID NO: 36 - DNA, 20 bp, synthetic construct
  misc_feature 1..20: note = Synthetic oligonucleotide
  source 1..20: mol_type = other DNA
gaattgcagcatgcctccat

SEQ ID NO: 37 - DNA, 20 bp, synthetic construct
  misc_feature 1..20: note = Synthetic oligonucleotide
  source 1..20: mol_type = other DNA
ctatgtcaaccttaccaaga

SEQ ID NO: 38 - DNA, 20 bp, synthetic construct
  misc_feature 1..20: note = Synthetic oligonucleotide
  source 1..20: mol_type = other DNA
gtttgctgcaacctattgct

SEQ ID NO: 39 - DNA, 20 bp, synthetic construct
  misc_feature 1..20: note = Synthetic oligonucleotide
  source 1..20: mol_type = other DNA
cctacactgcatcctagtcc

SEQ ID NO: 40 - DNA, 20 bp, synthetic construct
  misc_feature 1..20: note = Synthetic oligonucleotide
  source 1..20: mol_type = other DNA
gttctagtgccatatgggtc

SEQ ID NO: 41 - DNA, 20 bp, synthetic construct
  misc_feature 1..20: note = Synthetic oligonucleotide
  source 1..20: mol_type = other DNA
accgttctttatggtaacag

SEQ ID NO: 42 - DNA, 20 bp, synthetic construct
  misc_feature 1..20: note = Synthetic oligonucleotide
  source 1..20: mol_type = other DNA
ttggcttgattgtaatgtgg

SEQ ID NO: 43 - DNA, 20 bp, synthetic construct
  misc_feature 1..20: note = Synthetic oligonucleotide
  source 1..20: mol_type = other DNA
ggtacccaatgtctgttaga

SEQ ID NO: 44 - DNA, 20 bp, synthetic construct
  misc_feature 1..20: note = Synthetic oligonucleotide
  source 1..20: mol_type = other DNA
gttctgacagtcattcgatg

SEQ ID NO: 45 - DNA, 20 bp, synthetic construct
  misc_feature 1..20: note = Synthetic oligonucleotide
  source 1..20: mol_type = other DNA
cacgccagtcttcagcagtt

SEQ ID NO: 46 - DNA, 20 bp, synthetic construct
  misc_feature 1..20: note = Synthetic oligonucleotide
  source 1..20: mol_type = other DNA
cacctaaatcagggcagtgc

SEQ ID NO: 47 - DNA, 20 bp, synthetic construct
  misc_feature 1..20: note = Synthetic oligonucleotide
  source 1..20: mol_type = other DNA
gcattccccgctgcagtaag

SEQ ID NO: 48 - DNA, 20 bp, synthetic construct
  misc_feature 1..20: note = Synthetic oligonucleotide
  source 1..20: mol_type = other DNA
gcagaacagtagtattcctc

SEQ ID NO: 49 - DNA, 20 bp, synthetic construct
  misc_feature 1..20: note = Synthetic oligonucleotide
  source 1..20: mol_type = other DNA
ggagcttggtctgtcaaatg

SEQ ID NO: 50 - DNA, 20 bp, synthetic construct
  misc_feature 1..20: note = Synthetic oligonucleotide
  source 1..20: mol_type = other DNA
ttagttaagtaatggttggc

SEQ ID NO: 51 - DNA, 20 bp, synthetic construct
  misc_feature 1..20: note = Synthetic oligonucleotide
  source 1..20: mol_type = other DNA
atgttccactagtctacctc

SEQ ID NO: 52 - DNA, 20 bp, synthetic construct
  misc_feature 1..20: note = Synthetic oligonucleotide
  source 1..20: mol_type = other DNA
gcacaagactaaacagagtg

SEQ ID NO: 53 - DNA, 20 bp, synthetic construct
  misc_feature 1..20: note = Synthetic oligonucleotide
  source 1..20: mol_type = other DNA
gcaccagtggcccccttagt

SEQ ID NO: 54 - DNA, 20 bp, synthetic construct
  misc_feature 1..20: note = Synthetic oligonucleotide
  source 1..20: mol_type = other DNA
gccccccatggacagaaatt

SEQ ID NO: 55 - DNA, 20 bp, synthetic construct
  misc_feature 1..20: note = Synthetic oligonucleotide
  source 1..20: mol_type = other DNA
gcagcttagctgaatgccct

SEQ ID NO: 56 - DNA, 20 bp, synthetic construct
  misc_feature 1..20: note = Synthetic oligonucleotide
  source 1..20: mol_type = other DNA
catggtgccccttagtatgc

SEQ ID NO: 57 - DNA, 20 bp, synthetic construct
  misc_feature 1..20: note = Synthetic oligonucleotide
  source 1..20: mol_type = other DNA
tgttgacagaaagtcccctc

SEQ ID NO: 58 - DNA, 20 bp, synthetic construct
  misc_feature 1..20: note = Synthetic oligonucleotide
  source 1..20: mol_type = other DNA
ggagttaaaccatagagcca

SEQ ID NO: 59 - DNA, 20 bp, synthetic construct
  misc_feature 1..20: note = Synthetic oligonucleotide
  source 1..20: mol_type = other DNA
ctctccagcaagcaacggac

SEQ ID NO: 60 - DNA, 20 bp, synthetic construct
  misc_feature 1..20: note = Synthetic oligonucleotide
  source 1..20: mol_type = other DNA
cgcccattaatcacttgttg

SEQ ID NO: 61 - DNA, 20 bp, synthetic construct
  misc_feature 1..20: note = Synthetic oligonucleotide
  source 1..20: mol_type = other DNA
ccaccatgtttgcttggtgg

SEQ ID NO: 62 - DNA, 20 bp, synthetic construct
  misc_feature 1..20: note = Synthetic oligonucleotide
  source 1..20: mol_type = other DNA
ccccaccatattgctgcacc

SEQ ID NO: 63 - DNA, 20 bp, synthetic construct
  misc_feature 1..20: note = Synthetic oligonucleotide
  source 1..20: mol_type = other DNA
gggtgaaatagcctctgtcg

SEQ ID NO: 64 - DNA, 20 bp, synthetic construct
  misc_feature 1..20: note = Synthetic oligonucleotide
  source 1..20: mol_type = other DNA
ccttgtgtggctgcccacga

SEQ ID NO: 65 - DNA, 20 bp, synthetic construct
  misc_feature 1..20: note = Synthetic oligonucleotide
  source 1..20: mol_type = other DNA
ggtggaacagtctactgccc

SEQ ID NO: 66 - DNA, 20 bp, synthetic construct
  misc_feature 1..20: note = Synthetic oligonucleotide
  source 1..20: mol_type = other DNA
taacctgaatccactagccc

SEQ ID NO: 67 - DNA, 20 bp, synthetic construct
  misc_feature 1..20: note = Synthetic oligonucleotide
  source 1..20: mol_type = other DNA
gttcatggtttgtccagggc

SEQ ID NO: 68 - DNA, 20 bp, synthetic construct
  misc_feature 1..20: note = Synthetic oligonucleotide
  source 1..20: mol_type = other DNA
ggtctgtagctcggaccccc

SEQ ID NO: 69 - DNA, 20 bp, synthetic construct
  misc_feature 1..20: note = Synthetic oligonucleotide
  source 1..20: mol_type = other DNA
gactattagcctcactgcct

SEQ ID NO: 70 - DNA, 20 bp, synthetic construct
  misc_feature 1..20: note = Synthetic oligonucleotide
  source 1..20: mol_type = other DNA
cccctgtctccgtggagcga

SEQ ID NO: 71 - DNA, 20 bp, synthetic construct
  misc_feature 1..20: note = Synthetic oligonucleotide
  source 1..20: mol_type = other DNA
ccccgtggcagattggcacc

SEQ ID NO: 72 - DNA, 20 bp, synthetic construct
  misc_feature 1..20: note = Synthetic oligonucleotide
  source 1..20: mol_type = other DNA
gcagcactcatgctatccct

SEQ ID NO: 73 - DNA, 20 bp, synthetic construct
  misc_feature 1..20: note = Synthetic oligonucleotide
  source 1..20: mol_type = other DNA
aggaccgtatgcttgttcac

SEQ ID NO: 74 - DNA, 20 bp, synthetic construct
  misc_feature 1..20: note = Synthetic oligonucleotide
  source 1..20: mol_type = other DNA
ggcattcttcataggcaact

SEQ ID NO: 75 - DNA, 20 bp, synthetic construct
  misc_feature 1..20: note = Synthetic oligonucleotide
  source 1..20: mol_type = other DNA
gcctcacctctggtaggagc

SEQ ID NO: 76 - DNA, 20 bp, synthetic construct
  misc_feature 1..20: note = Synthetic oligonucleotide
  source 1..20: mol_type = other DNA
tcacagattaagctgtcccc

SEQ ID NO: 77 - DNA, 20 bp, synthetic construct
  misc_feature 1..20: note = Synthetic oligonucleotide
  source 1..20: mol_type = other DNA
tgtcccctccctacatagtc

SEQ ID NO: 78 - DNA, 20 bp, synthetic construct
  misc_feature 1..20: note = Synthetic oligonucleotide
  source 1..20: mol_type = other DNA
gctcccatttaccctaatcc

SEQ ID NO: 79 - DNA, 20 bp, synthetic construct
  misc_feature 1..20: note = Synthetic oligonucleotide
  source 1..20: mol_type = other DNA
atatcaccactgtgggccgg

SEQ ID NO: 80 - DNA, 20 bp, synthetic construct
  misc_feature 1..20: note = Synthetic oligonucleotide
  source 1..20: mol_type = other DNA
tggtctaaactatacatggc

SEQ ID NO: 81 - DNA, 20 bp, synthetic construct
  misc_feature 1..20: note = Synthetic oligonucleotide
  source 1..20: mol_type = other DNA
tggacttcctttgttaccga

SEQ ID NO: 82 - DNA, 20 bp, synthetic construct
  misc_feature 1..20: note = Synthetic oligonucleotide
  source 1..20: mol_type = other DNA
cttcctcgccaaacagttcg

SEQ ID NO: 83 - DNA, 20 bp, synthetic construct
  misc_feature 1..20: note = Synthetic oligonucleotide
  source 1..20: mol_type = other DNA
acaccctaggagcaagagtt

SEQ ID NO: 84 - DNA, 20 bp, synthetic construct
  misc_feature 1..20: note = Synthetic oligonucleotide
  source 1..20: mol_type = other DNA
gaactgtagtttaactgtgg

SEQ ID NO: 85 - DNA, 20 bp, synthetic construct
  misc_feature 1..20: note = Synthetic oligonucleotide
  source 1..20: mol_type = other DNA
cgtactctaggccctatgga

SEQ ID NO: 86 - DNA, 20 bp, synthetic construct
  misc_feature 1..20: note = Synthetic oligonucleotide
  source 1..20: mol_type = other DNA
gacctcggctcatgcactgc

SEQ ID NO: 87 - DNA, 20 bp, synthetic construct
  misc_feature 1..20: note = Synthetic oligonucleotide
  source 1..20: mol_type = other DNA
agctccatacaaggacctaa

SEQ ID NO: 88 - DNA, 20 bp, synthetic construct
  misc_feature 1..20: note = Synthetic oligonucleotide
  source 1..20: mol_type = other DNA
ggcattcagtcttaccctca

SEQ ID NO: 89 - DNA, 20 bp, synthetic construct
  misc_feature 1..20: note = Synthetic oligonucleotide
  source 1..20: mol_type = other DNA
cattgtgtatgtctataggg

SEQ ID NO: 90 - DNA, 20 bp, synthetic construct
  misc_feature 1..20: note = Synthetic oligonucleotide
  source 1..20: mol_type = other DNA
cccttggtgtacccttctca

SEQ ID NO: 91 - DNA, 20 bp, synthetic construct
  misc_feature 1..20: note = Synthetic oligonucleotide
  source 1..20: mol_type = other DNA
gctattcttacagcaggtcg

SEQ ID NO: 92 - DNA, 20 bp, synthetic construct
  misc_feature 1..20: note = Synthetic oligonucleotide
  source 1..20: mol_type = other DNA
taacctctgttgggctgcct

SEQ ID NO: 93 - DNA, 20 bp, synthetic construct
  misc_feature 1..20: note = Synthetic oligonucleotide
  source 1..20: mol_type = other DNA
caggtaagtagtgtaaatag

SEQ ID NO: 94 - DNA, 20 bp, synthetic construct
  misc_feature 1..20: note = Synthetic oligonucleotide
  source 1..20: mol_type = other DNA
taactaccactagagggcgg

SEQ ID NO: 95 - DNA, 20 bp, synthetic construct
  misc_feature 1..20: note = Synthetic oligonucleotide
  source 1..20: mol_type = other DNA
gggattgataagctggcacc

SEQ ID NO: 96 - DNA, 20 bp, synthetic construct
  misc_feature 1..20: note = Synthetic oligonucleotide
  source 1..20: mol_type = other DNA
cgttcctgtttgggtctctt

SEQ ID NO: 97 - DNA, 20 bp, synthetic construct
  misc_feature 1..20: note = Synthetic oligonucleotide
  source 1..20: mol_type = other DNA
caactgcaatcctattagcg

SEQ ID NO: 98 - DNA, 20 bp, synthetic construct
  misc_feature 1..20: note = Synthetic oligonucleotide
  source 1..20: mol_type = other DNA
gctcactgtcctattgaaag

SEQ ID NO: 99 - DNA, 20 bp, synthetic construct
  misc_feature 1..20: note = Synthetic oligonucleotide
  source 1..20: mol_type = other DNA
gattccgattttcggactct

SEQ ID NO: 100 - DNA, 20 bp, synthetic construct
  misc_feature 1..20: note = Synthetic oligonucleotide
  source 1..20: mol_type = other DNA
cttcggctgtcattgtcctc

SEQ ID NO: 101 - DNA, 20 bp, synthetic construct
  misc_feature 1..20: note = Synthetic oligonucleotide
  source 1..20: mol_type = other DNA
ggctgacattgctgtggcgc

SEQ ID NO: 102 - DNA, 20 bp, synthetic construct
  misc_feature 1..20: note = Synthetic oligonucleotide
  source 1..20: mol_type = other DNA
ggtttacaacagtcccaaat

SEQ ID NO: 103 - DNA, 20 bp, synthetic construct
  misc_feature 1..20: note = Synthetic oligonucleotide
  source 1..20: mol_type = other DNA
ccgtctttgagataattgag

SEQ ID NO: 104 - DNA, 20 bp, synthetic construct
  misc_feature 1..20: note = Synthetic oligonucleotide
  source 1..20: mol_type = other DNA
ccaatatcaaccgtgctgcc

SEQ ID NO: 105 - DNA, 20 bp, synthetic construct
  misc_feature 1..20: note = Synthetic oligonucleotide
  source 1..20: mol_type = other DNA
gttctccctcggcgggagct

SEQ ID NO: 106 - DNA, 20 bp, synthetic construct
  misc_feature 1..20: note = Synthetic oligonucleotide
  source 1..20: mol_type = other DNA
gacaacacttgaacttccgt

SEQ ID NO: 107 - DNA, 20 bp, synthetic construct
  misc_feature 1..20: note = Synthetic oligonucleotide
  source 1..20: mol_type = other DNA
tgttgaccacgcttacatca

SEQ ID NO: 108 - DNA, 20 bp, synthetic construct
  misc_feature 1..20: note = Synthetic oligonucleotide
  source 1..20: mol_type = other DNA
tgattgctctcaatgagagc

SEQ ID NO: 109 - DNA, 20 bp, synthetic construct
  misc_feature 1..20: note = Synthetic oligonucleotide
  source 1..20: mol_type = other DNA
ggttgtcttcatacttgggt

SEQ ID NO: 110 - DNA, 20 bp, synthetic construct
  misc_feature 1..20: note = Synthetic oligonucleotide
  source 1..20: mol_type = other DNA
gggtgttccatcacattctt

SEQ ID NO: 111 - DNA, 20 bp, synthetic construct
  misc_feature 1..20: note = Synthetic oligonucleotide
  source 1..20: mol_type = other DNA
gtgggagtcctgttgacaca

SEQ ID NO: 112 - DNA, 20 bp, synthetic construct
  misc_feature 1..20: note = Synthetic oligonucleotide
  source 1..20: mol_type = other DNA
acctcccatcgatactattt

SEQ ID NO: 113 - DNA, 20 bp, synthetic construct
  misc_feature 1..20: note = Synthetic oligonucleotide
  source 1..20: mol_type = other DNA
ctgagtagccattacgcctc

SEQ ID NO: 114 - DNA, 20 bp, synthetic construct
  misc_feature 1..20: note = Synthetic oligonucleotide
  source 1..20: mol_type = other DNA
cgaatagctatttaagcacc

SEQ ID NO: 115 - DNA, 20 bp, synthetic construct
  misc_feature 1..20: note = Synthetic oligonucleotide
  source 1..20: mol_type = other DNA
tatactatgtcaaccttacc

SEQ ID NO: 116 - DNA, 20 bp, synthetic construct
  misc_feature 1..20: note = Synthetic oligonucleotide
  source 1..20: mol_type = other DNA
gtcgggcttttcatcattga

SEQ ID NO: 117 - DNA, 20 bp, synthetic construct
  misc_feature 1..20: note = Synthetic oligonucleotide
  source 1..20: mol_type = other DNA
tgtgtgcaagtttacagtac

SEQ ID NO: 118 - DNA, 20 bp, synthetic construct
  misc_feature 1..20: note = Synthetic oligonucleotide
  source 1..20: mol_type = other DNA
cagttctagtgccatatggg

SEQ ID NO: 119 - DNA, 20 bp, synthetic construct
  misc_feature 1..20: note = Synthetic oligonucleotide
  source 1..20: mol_type = other DNA
ggtttaccgttctttatggt

SEQ ID NO: 120 - DNA, 20 bp, synthetic construct
  misc_feature 1..20: note = Synthetic oligonucleotide
  source 1..20: mol_type = other DNA
gtagttatccaatacactct

SEQ ID NO: 121 - DNA, 20 bp, synthetic construct
  misc_feature 1..20: note = Synthetic oligonucleotide
  source 1..20: mol_type = other DNA
cgatggtacccaatgtctgt

SEQ ID NO: 122 - DNA, 20 bp, synthetic construct
  misc_feature 1..20: note = Synthetic oligonucleotide
  source 1..20: mol_type = other DNA
ctgttctgacagtcattcga

SEQ ID NO: 123 - DNA, 20 bp, synthetic construct
  misc_feature 1..20: note = Synthetic oligonucleotide
  source 1..20: mol_type = other DNA
gacagaccacgccagtcttc

SEQ ID NO: 124 - DNA, 20 bp, synthetic construct
  misc_feature 1..20: note = Synthetic oligonucleotide
  source 1..20: mol_type = other DNA
tccacacctaaatcagggca

SEQ ID NO: 125 - DNA, 20 bp, synthetic construct
  misc_feature 1..20: note = Synthetic oligonucleotide
  source 1..20: mol_type = other DNA
ctgcattccccgctgcagta

SEQ ID NO: 126 - DNA, 20 bp, synthetic construct
  misc_feature 1..20: note = Synthetic oligonucleotide
  source 1..20: mol_type = other DNA
tagtccagcagaacagtagt

SEQ ID NO: 127 - DNA, 20 bp, synthetic construct
  misc_feature 1..20: note = Synthetic oligonucleotide
  source 1..20: mol_type = other DNA
ggccatggagcactacccca

SEQ ID NO: 128 - DNA, 20 bp, synthetic construct
  misc_feature 1..20: note = Synthetic oligonucleotide
  source 1..20: mol_type = other DNA
gttagttaagtaatggttgg

SEQ ID NO: 129 - DNA, 20 bp, synthetic construct
  misc_feature 1..20: note = Synthetic oligonucleotide
  source 1..20: mol_type = other DNA
cgcgccctgctgcacaggtg

SEQ ID NO: 130 - DNA, 20 bp, synthetic construct
  misc_feature 1..20: note = Synthetic oligonucleotide
  source 1..20: mol_type = other DNA
ctacccttttatttgggtag

SEQ ID NO: 131 - DNA, 20 bp, synthetic construct
  misc_feature 1..20: note = Synthetic oligonucleotide
  source 1..20: mol_type = other DNA
atgctcacaatctagactcc

SEQ ID NO: 132 - DNA, 20 bp, synthetic construct
  misc_feature 1..20: note = Synthetic oligonucleotide
  source 1..20: mol_type = other DNA
ggcctcctatgatattgtta

SEQ ID NO: 133 - DNA, 20 bp, synthetic construct
  misc_feature 1..20: note = Synthetic oligonucleotide
  source 1..20: mol_type = other DNA
ggcatgattgctgggcatca

SEQ ID NO: 134 - DNA, 20 bp, synthetic construct
  misc_feature 1..20: note = Synthetic oligonucleotide
  source 1..20: mol_type = other DNA
ccagtgctttgctccacacg

SEQ ID NO: 135 - DNA, 20 bp, synthetic construct
  misc_feature 1..20: note = Synthetic oligonucleotide
  source 1..20: mol_type = other DNA
gcccgtccccactgaccaat

SEQ ID NO: 136 - DNA, 20 bp, synthetic construct
  misc_feature 1..20: note = Synthetic oligonucleotide
  source 1..20: mol_type = other DNA
tggagttaaaccatagagcc

SEQ ID NO: 137 - DNA, 20 bp, synthetic construct
  misc_feature 1..20: note = Synthetic oligonucleotide
  source 1..20: mol_type = other DNA
gcctactataatagccccca

SEQ ID NO: 138 - DNA, 20 bp, synthetic construct
  misc_feature 1..20: note = Synthetic oligonucleotide
  source 1..20: mol_type = other DNA
tagtgcaggattttgcccac

SEQ ID NO: 139 - DNA, 20 bp, synthetic construct
  misc_feature 1..20: note = Synthetic oligonucleotide
  source 1..20: mol_type = other DNA
tggtcacatatgaggtccaa

SEQ ID NO: 140 - DNA, 20 bp, synthetic construct
  misc_feature 1..20: note = Synthetic oligonucleotide
  source 1..20: mol_type = other DNA
agcccgggctgcccggaaaa

SEQ ID NO: 141 - DNA, 20 bp, synthetic construct
  misc_feature 1..20: note = Synthetic oligonucleotide
  source 1..20: mol_type = other DNA
ataatgtgctcacggtcttc

SEQ ID NO: 142 - DNA, 20 bp, synthetic construct
  misc_feature 1..20: note = Synthetic oligonucleotide
  source 1..20: mol_type = other DNA
ccccagctgcgagtagtgcc

SEQ ID NO: 143 - DNA, 20 bp, synthetic construct
  misc_feature 1..20: note = Synthetic oligonucleotide
  source 1..20: mol_type = other DNA
ggtgagccccatgttcagcc

SEQ ID NO: 144 - DNA, 20 bp, synthetic construct
  misc_feature 1..20: note = Synthetic oligonucleotide
  source 1..20: mol_type = other DNA
gtggttgtggataagtgcgc

SEQ ID NO: 145 - DNA, 20 bp, synthetic construct
  misc_feature 1..20: note = Synthetic oligonucleotide
  source 1..20: mol_type = other DNA
ttggttcatggtttgtccag

SEQ ID NO: 146 - DNA, 20 bp, synthetic construct
  misc_feature 1..20: note = Synthetic oligonucleotide
  source 1..20: mol_type = other DNA
gaatctcatatgtgcatcca

SEQ ID NO: 147 - DNA, 20 bp, synthetic construct
  misc_feature 1..20: note = Synthetic oligonucleotide
  source 1..20: mol_type = other DNA
atgttgcatcccaatgctta

SEQ ID NO: 148 - DNA, 20 bp, synthetic construct
  misc_feature 1..20: note = Synthetic oligonucleotide
  source 1..20: mol_type = other DNA
agggtcaagtttttacgctt

SEQ ID NO: 149 - DNA, 20 bp, synthetic construct
  misc_feature 1..20: note = Synthetic oligonucleotide
  source 1..20: mol_type = other DNA
gcaggtatagccaatgccct

SEQ ID NO: 150 - DNA, 20 bp, synthetic construct
  misc_feature 1..20: note = Synthetic oligonucleotide
  source 1..20: mol_type = other DNA
aacagctattttaccggcaa

SEQ ID NO: 151 - DNA, 20 bp, synthetic construct
  misc_feature 1..20: note = Synthetic oligonucleotide
  source 1..20: mol_type = other DNA
ccacctctggtgatactgca

SEQ ID NO: 152 - DNA, 20 bp, synthetic construct
  misc_feature 1..20: note = Synthetic oligonucleotide
  source 1..20: mol_type = other DNA
cagacacgatgggccctcca

SEQ ID NO: 153 - DNA, 20 bp, synthetic construct
  misc_feature 1..20: note = Synthetic oligonucleotide
  source 1..20: mol_type = other DNA
gtgattggttttgggccact

SEQ ID NO: 154 - DNA, 20 bp, synthetic construct
  misc_feature 1..20: note = Synthetic oligonucleotide
  source 1..20: mol_type = other DNA
gctaacgcaggcgaggttgg

SEQ ID NO: 155 - DNA, 20 bp, synthetic construct
  misc_feature 1..20: note = Synthetic oligonucleotide
  source 1..20: mol_type = other DNA
gatacagtttcccaactgcg

SEQ ID NO: 156 - DNA, 20 bp, synthetic construct
  misc_feature 1..20: note = Synthetic oligonucleotide
  source 1..20: mol_type = other DNA
ctatgtaccgctttaatcta

SEQ ID NO: 157 - DNA, 20 bp, synthetic construct
  misc_feature 1..20: note = Synthetic oligonucleotide
  source 1..20: mol_type = other DNA
cctagcagtgcgggcttcca

SEQ ID NO: 158 - DNA, 20 bp, synthetic construct
  misc_feature 1..20: note = Synthetic oligonucleotide
  source 1..20: mol_type = other DNA
cggtgtgctgtgacccatct

SEQ ID NO: 159 - DNA, 20 bp, synthetic construct
  misc_feature 1..20: note = Synthetic oligonucleotide
  source 1..20: mol_type = other DNA
gcagccaatctacccgtggt

SEQ ID NO: 160 - DNA, 20 bp, synthetic construct
  misc_feature 1..20: note = Synthetic oligonucleotide
  source 1..20: mol_type = other DNA
gtaattctttgccccaggac

SEQ ID NO: 161 - DNA, 20 bp, synthetic construct
  misc_feature 1..20: note = Synthetic oligonucleotide
  source 1..20: mol_type = other DNA
acccttgcctctttccgaga

SEQ ID NO: 162 - DNA, 20 bp, synthetic construct
  misc_feature 1..20: note = Synthetic oligonucleotide
  source 1..20: mol_type = other DNA
gctccctttcattttagtgc

SEQ ID NO: 163 - DNA, 20 bp, synthetic construct
  misc_feature 1..20: note = Synthetic oligonucleotide
  source 1..20: mol_type = other DNA
gacttcgggtgaccccaagg

SEQ ID NO: 164 - DNA, 20 bp, synthetic construct
  misc_feature 1..20: note = Synthetic oligonucleotide
  source 1..20: mol_type = other DNA
gctcctaccggcacccatgc

SEQ ID NO: 165 - DNA, 20 bp, synthetic construct
  misc_feature 1..20: note = Synthetic oligonucleotide
  source 1..20: mol_type = other DNA
ttggtctcagtgtaccccca

SEQ ID NO: 166 - DNA, 20 bp, synthetic construct
  misc_feature 1..20: note = Synthetic oligonucleotide
  source 1..20: mol_type = other DNA
cacagcggagtagtgaagaa

SEQ ID NO: 167 - DNA, 20 bp, synthetic construct
  misc_feature 1..20: note = Synthetic oligonucleotide
  source 1..20: mol_type = other DNA
cccttttcaaccccccttgg

SEQ ID NO: 168 - DNA, 20 bp, synthetic construct
  misc_feature 1..20: note = Synthetic oligonucleotide
  source 1..20: mol_type = other DNA
gaacagtggcggccagtagt

SEQ ID NO: 169 - DNA, 20 bp, synthetic construct
  misc_feature 1..20: note = Synthetic oligonucleotide
  source 1..20: mol_type = other DNA
acacccctaccactacaggt

SEQ ID NO: 170 - DNA, 20 bp, synthetic construct
  misc_feature 1..20: note = Synthetic oligonucleotide
  source 1..20: mol_type = other DNA
tcttaatgctacctcatagc

SEQ ID NO: 171 - DNA, 20 bp, synthetic construct
  misc_feature 1..20: note = Synthetic oligonucleotide
  source 1..20: mol_type = other DNA
caggagtatgaccaggtaca

SEQ ID NO: 172 - DNA, 20 bp, synthetic construct
  misc_feature 1..20: note = Synthetic oligonucleotide
  source 1..20: mol_type = other DNA
tgtaactaccactagagggc

SEQ ID NO: 173 - DNA, 20 bp, synthetic construct
  misc_feature 1..20: note = Synthetic oligonucleotide
  source 1..20: mol_type = other DNA
gagtttgggattgataagct

SEQ ID NO: 174 - DNA, 20 bp, synthetic construct
  misc_feature 1..20: note = Synthetic oligonucleotide
  source 1..20: mol_type = other DNA
atcgagagattgctttccct

SEQ ID NO: 175 - DNA, 20 bp, synthetic construct
  misc_feature 1..20: note = Synthetic oligonucleotide
  source 1..20: mol_type = other DNA
gaattatctggaggccattg

SEQ ID NO: 176 - DNA, 20 bp, synthetic construct
  misc_feature 1..20: note = Synthetic oligonucleotide
  source 1..20: mol_type = other DNA
gattcagcagatgcggctgc

SEQ ID NO: 177 - DNA, 20 bp, synthetic construct
  misc_feature 1..20: note = Synthetic oligonucleotide
  source 1..20: mol_type = other DNA
aggctcgccctactgttgcg

SEQ ID NO: 178 - DNA, 20 bp, synthetic construct
  misc_feature 1..20: note = Synthetic oligonucleotide
  source 1..20: mol_type = other DNA
ctcttcggctgtcattgtcc

SEQ ID NO: 179 - DNA, 20 bp, synthetic construct
  misc_feature 1..20: note = Synthetic oligonucleotide
  source 1..20: mol_type = other DNA
gcccccgaccagggagacca

SEQ ID NO: 180 - DNA, 20 bp, synthetic construct
  misc_feature 1..20: note = Synthetic oligonucleotide
  source 1..20: mol_type = other DNA
ccatggtttacaacagtccc

SEQ ID NO: 181 - DNA, 20 bp, synthetic construct
  misc_feature 1..20: note = Synthetic oligonucleotide
  source 1..20: mol_type = other DNA
gctgcctatgccactagtag

SEQ ID NO: 182 - DNA, 20 bp, synthetic construct
  misc_feature 1..20: note = Synthetic oligonucleotide
  source 1..20: mol_type = other DNA
gctccaatatcaaccgtgct

SEQ ID NO: 183 - DNA, 20 bp, synthetic construct
  misc_feature 1..20: note = Synthetic oligonucleotide
  source 1..20: mol_type = other DNA
ggctgttctccctcggcggg

SEQ ID NO: 184 - DNA, 20 bp, synthetic construct
  misc_feature 1..20: note = Synthetic oligonucleotide
  source 1..20: mol_type = other DNA
gtgctccactatcttatagc

SEQ ID NO: 185 - DNA, 20 bp, synthetic construct
  misc_feature 1..20: note = Synthetic oligonucleotide
  source 1..20: mol_type = other DNA
agttgttgaccacgcttaca

SEQ ID NO: 186 - DNA, 20 bp, synthetic construct
  misc_feature 1..20: note = Synthetic oligonucleotide
  source 1..20: mol_type = other DNA
gtttgattgctctcaatgag

SEQ ID NO: 187 - DNA, 20 bp, synthetic construct
  misc_feature 1..20: note = Synthetic oligonucleotide
  source 1..20: mol_type = other DNA
gtaacgaagagagatcagtt

SEQ ID NO: 188 - DNA, 20 bp, synthetic construct
  misc_feature 1..20: note = Synthetic oligonucleotide
  source 1..20: mol_type = other DNA
tgatgggtgttccatcacat

SEQ ID NO: 189 - DNA, 20 bp, synthetic construct
  misc_feature 1..20: note = Synthetic oligonucleotide
  source 1..20: mol_type = other DNA
cctgtgggagtcctgttgac

SEQ ID NO: 190 - DNA, 20 bp, synthetic construct
  misc_feature 1..20: note = Synthetic oligonucleotide
  source 1..20: mol_type = other DNA
gaaacctcccatcgatacta

SEQ ID NO: 191 - DNA, 20 bp, synthetic construct
  misc_feature 1..20: note = Synthetic oligonucleotide
  source 1..20: mol_type = other DNA
gtctgagtagccattacgcc

SEQ ID NO: 192 - DNA, 20 bp, synthetic construct
  misc_feature 1..20: note = Synthetic oligonucleotide
  source 1..20: mol_type = other DNA
tacgaatagctatttaagca

SEQ ID NO: 193 - DNA, 20 bp, synthetic construct
  misc_feature 1..20: note = Synthetic oligonucleotide
  source 1..20: mol_type = other DNA
gcttcaaactataatggaac

SEQ ID NO: 194 - DNA, 20 bp, synthetic construct
  misc_feature 1..20: note = Synthetic oligonucleotide
  source 1..20: mol_type = other DNA
acagtcgggcttttcatcat

SEQ ID NO: 195 - DNA, 20 bp, synthetic construct
  misc_feature 1..20: note = Synthetic oligonucleotide
  source 1..20: mol_type = other DNA
gactaggtggaaacattgga

SEQ ID NO: 196 - DNA, 20 bp, synthetic construct
  misc_feature 1..20: note = Synthetic oligonucleotide
  source 1..20: mol_type = other DNA
gatacagttctagtgccata

SEQ ID NO: 197 - DNA, 20 bp, synthetic construct
  misc_feature 1..20: note = Synthetic oligonucleotide
  source 1..20: mol_type = other DNA
gtggtttaccgttctttatg

SEQ ID NO: 198 - DNA, 20 bp, synthetic construct
  misc_feature 1..20: note = Synthetic oligonucleotide
  source 1..20: mol_type = other DNA
ccatatctagctttttggcc

SEQ ID NO: 199 - DNA, 20 bp, synthetic construct
  misc_feature 1..20: note = Synthetic oligonucleotide
  source 1..20: mol_type = other DNA
cattcgatggtacccaatgt

SEQ ID NO: 200 - DNA, 20 bp, synthetic construct
  misc_feature 1..20: note = Synthetic oligonucleotide
  source 1..20: mol_type = other DNA
gtttggttgctacaatccct

SEQ ID NO: 201 - DNA, 20 bp, synthetic construct
  misc_feature 1..20: note = Synthetic oligonucleotide
  source 1..20: mol_type = other DNA
cagacagaccacgccagtct

SEQ ID NO: 202 - DNA, 20 bp, synthetic construct
  misc_feature 1..20: note = Synthetic oligonucleotide
  source 1..20: mol_type = other DNA
ggcatcatccacacctaaat

SEQ ID NO: 203 - DNA, 20 bp, synthetic construct
  misc_feature 1..20: note = Synthetic oligonucleotide
  source 1..20: mol_type = other DNA
tactctgcattccccgctgc

SEQ ID NO: 204 - DNA, 20 bp, synthetic construct
  misc_feature 1..20: note = Synthetic oligonucleotide
  source 1..20: mol_type = other DNA
cacttcattagtccagcaga

SEQ ID NO: 205 - DNA, 20 bp, synthetic construct
  misc_feature 1..20: note = Synthetic oligonucleotide
  source 1..20: mol_type = other DNA
attggcccacatatgtcaat

SEQ ID NO: 206 - DNA, 20 bp, synthetic construct
  misc_feature 1..20: note = Synthetic oligonucleotide
  source 1..20: mol_type = other DNA
ggttagttaagtaatggttg

SEQ ID NO: 207 - DNA, 20 bp, synthetic construct
  misc_feature 1..20: note = Synthetic oligonucleotide
  source 1..20: mol_type = other DNA
gctagacaaatcccaatcct

SEQ ID NO: 208 - DNA, 20 bp, synthetic construct
  misc_feature 1..20: note = Synthetic oligonucleotide
  source 1..20: mol_type = other DNA
gctttccagtgcgccccagg

SEQ ID NO: 209 - DNA, 20 bp, synthetic construct
  misc_feature 1..20: note = Synthetic oligonucleotide
  source 1..20: mol_type = other DNA
gcacgccacctcatgccccc

SEQ ID NO: 210 - DNA, 20 bp, synthetic construct
  misc_feature 1..20: note = Synthetic oligonucleotide
  source 1..20: mol_type = other DNA
gtctcttccacgaccttggt

SEQ ID NO: 211 - DNA, 20 bp, synthetic construct
  misc_feature 1..20: note = Synthetic oligonucleotide
  source 1..20: mol_type = other DNA
atctagggacatgtggcatg

SEQ ID NO: 212 - DNA, 20 bp, synthetic construct
  misc_feature 1..20: note = Synthetic oligonucleotide
  source 1..20: mol_type = other DNA
gactctttaggagagttaac

SEQ ID NO: 213 - DNA, 20 bp, synthetic construct
  misc_feature 1..20: note = Synthetic oligonucleotide
  source 1..20: mol_type = other DNA
aggctataagtggcctctca

SEQ ID NO: 214 - DNA, 20 bp, synthetic construct
  misc_feature 1..20: note = Synthetic oligonucleotide
  source 1..20: mol_type = other DNA
gggttaaaccatagagccat

SEQ ID NO: 215 - DNA, 20 bp, synthetic construct
  misc_feature 1..20: note = Synthetic oligonucleotide
  source 1..20: mol_type = other DNA
gattccgtgaatgggtctgg

SEQ ID NO: 216 - DNA, 20 bp, synthetic construct
  misc_feature 1..20: note = Synthetic oligonucleotide
  source 1..20: mol_type = other DNA
cctatcagagggtgtgtgac

SEQ ID NO: 217 - DNA, 20 bp, synthetic construct
  misc_feature 1..20: note = Synthetic oligonucleotide
  source 1..20: mol_type = other DNA
ggcgatagtagccagagtcc

SEQ ID NO: 218 - DNA, 20 bp, synthetic construct
  misc_feature 1..20: note = Synthetic oligonucleotide
  source 1..20: mol_type = other DNA
atagccaagcccgggctgcc

SEQ ID NO: 219 - DNA, 20 bp, synthetic construct
  misc_feature 1..20: note = Synthetic oligonucleotide
  source 1..20: mol_type = other DNA
cctcttaccaacccccacga

SEQ ID NO: 220 - DNA, 20 bp, synthetic construct
  misc_feature 1..20: note = Synthetic oligonucleotide
  source 1..20: mol_type = other DNA
gaggccccagctgcgagtag

SEQ ID NO: 221 - DNA, 20 bp, synthetic construct
  misc_feature 1..20: note = Synthetic oligonucleotide
  source 1..20: mol_type = other DNA
cgccgtaaccaggccataac

SEQ ID NO: 222 - DNA, 20 bp, synthetic construct
  misc_feature 1..20: note = Synthetic oligonucleotide
  source 1..20: mol_type = other DNA
ctctcccattgattctagcc

SEQ ID NO: 223 - DNA, 20 bp, synthetic construct
  misc_feature 1..20: note = Synthetic oligonucleotide
  source 1..20: mol_type = other DNA
gatattagcctcagccccag

SEQ ID NO: 224 - DNA, 20 bp, synthetic construct
  misc_feature 1..20: note = Synthetic oligonucleotide
  source 1..20: mol_type = other DNA
ttcccgcgctggaggatgcc

SEQ ID NO: 225 - DNA, 20 bp, synthetic construct
  misc_feature 1..20: note = Synthetic oligonucleotide
  source 1..20: mol_type = other DNA
atcggtcccagtctccttgc

SEQ ID NO: 226 - DNA, 20 bp, synthetic construct
  misc_feature 1..20: note = Synthetic oligonucleotide
  source 1..20: mol_type = other DNA
ctagggtcaagtttttacgc

SEQ ID NO: 227 - DNA, 20 bp, synthetic construct
  misc_feature 1..20: note = Synthetic oligonucleotide
  source 1..20: mol_type = other DNA
gcactaccatgccttcacca

SEQ ID NO: 228 - DNA, 20 bp, synthetic construct
  misc_feature 1..20: note = Synthetic oligonucleotide
  source 1..20: mol_type = other DNA
gcatcaaccaaatagggcca

SEQ ID NO: 229 - DNA, 20 bp, synthetic construct
  misc_feature 1..20: note = Synthetic oligonucleotide
  source 1..20: mol_type = other DNA
ctgccgcctagaagggcgca

SEQ ID NO: 230 - DNA, 20 bp, synthetic construct
  misc_feature 1..20: note = Synthetic oligonucleotide
  source 1..20: mol_type = other DNA
gtgccccatccgttagcatc

SEQ ID NO: 231 - DNA, 20 bp, synthetic construct
  misc_feature 1..20: note = Synthetic oligonucleotide
  source 1..20: mol_type = other DNA
aggttcagtaaccagcatac

SEQ ID NO: 232 - DNA, 20 bp, synthetic construct
  misc_feature 1..20: note = Synthetic oligonucleotide
  source 1..20: mol_type = other DNA
aaccccatgtcacatagttc

SEQ ID NO: 233 - DNA, 20 bp, synthetic construct
  misc_feature 1..20: note = Synthetic oligonucleotide
  source 1..20: mol_type = other DNA
cgtaagaccagccccagctt

SEQ ID NO: 234 - DNA, 20 bp, synthetic construct
  misc_feature 1..20: note = Synthetic oligonucleotide
  source 1..20: mol_type = other DNA
agctgtctacatacccctga

SEQ ID NO: 235 - DNA, 20 bp, synthetic construct
  misc_feature 1..20: note = Synthetic oligonucleotide
  source 1..20: mol_type = other DNA
ggtggtatggcaatccaatt

SEQ ID NO: 236 - DNA, 20 bp, synthetic construct
  misc_feature 1..20: note = Synthetic oligonucleotide
  source 1..20: mol_type = other DNA
atccctcagtcactgggtac

SEQ ID NO: 237 - DNA, 20 bp, synthetic construct
  misc_feature 1..20: note = Synthetic oligonucleotide
  source 1..20: mol_type = other DNA
atcaatccttccccagggcg

SEQ ID NO: 238 - DNA, 20 bp, synthetic construct
  misc_feature 1..20: note = Synthetic oligonucleotide
  source 1..20: mol_type = other DNA
cgctcttttggaaaacccac

SEQ ID NO: 239 - DNA, 20 bp, synthetic construct
  misc_feature 1..20: note = Synthetic oligonucleotide
  source 1..20: mol_type = other DNA
tgctcagtagattaccagtg

SEQ ID NO: 240 - DNA, 20 bp, synthetic construct
  misc_feature 1..20: note = Synthetic oligonucleotide
  source 1..20: mol_type = other DNA
ggataatacaccaatatagt

SEQ ID NO: 241 - DNA, 20 bp, synthetic construct
  misc_feature 1..20: note = Synthetic oligonucleotide
  source 1..20: mol_type = other DNA
ggccacagcattctcggacc

SEQ ID NO: 242 - DNA, 20 bp, synthetic construct
  misc_feature 1..20: note = Synthetic oligonucleotide
  source 1..20: mol_type = other DNA
aggacgggtacctggcgagg

SEQ ID NO: 243 - DNA, 20 bp, synthetic construct
  misc_feature 1..20: note = Synthetic oligonucleotide
  source 1..20: mol_type = other DNA
ggctacttggtcaatagcca

SEQ ID NO: 244 - DNA, 20 bp, synthetic construct
  misc_feature 1..20: note = Synthetic oligonucleotide
  source 1..20: mol_type = other DNA
acaccattcatctctagttg

SEQ ID NO: 245 - DNA, 20 bp, synthetic construct
  misc_feature 1..20: note = Synthetic oligonucleotide
  source 1..20: mol_type = other DNA
tgttttgcgatatgcattga

SEQ ID NO: 246 - DNA, 20 bp, synthetic construct
  misc_feature 1..20: note = Synthetic oligonucleotide
  source 1..20: mol_type = other DNA
tattcttacagcaggtcgag

SEQ ID NO: 247 - DNA, 20 bp, synthetic construct
  misc_feature 1..20: note = Synthetic oligonucleotide
  source 1..20: mol_type = other DNA
gttaacggtttcttactgct

SEQ ID NO: 248 - DNA, 20 bp, synthetic construct
  misc_feature 1..20: note = Synthetic oligonucleotide
  source 1..20: mol_type = other DNA
gggaagctccatgtcagatc

SEQ ID NO: 249 - DNA, 20 bp, synthetic construct
  misc_feature 1..20: note = Synthetic oligonucleotide
  source 1..20: mol_type = other DNA
ccccaaataggtagaacctt

SEQ ID NO: 250 - DNA, 20 bp, synthetic construct
  misc_feature 1..20: note = Synthetic oligonucleotide
  source 1..20: mol_type = other DNA
attgtaactaccactagagg

SEQ ID NO: 251 - DNA, 20 bp, synthetic construct
  misc_feature 1..20: note = Synthetic oligonucleotide
  source 1..20: mol_type = other DNA
ggcggtaccagcactgactg

SEQ ID NO: 252 - DNA, 20 bp, synthetic construct
  misc_feature 1..20: note = Synthetic oligonucleotide
  source 1..20: mol_type = other DNA
ctattagcgcaaacacgctt

SEQ ID NO: 253 - DNA, 20 bp, synthetic construct
  misc_feature 1..20: note = Synthetic oligonucleotide
  source 1..20: mol_type = other DNA
agtaccattcccatccaatg

SEQ ID NO: 254 - DNA, 20 bp, synthetic construct
  misc_feature 1..20: note = Synthetic oligonucleotide
  source 1..20: mol_type = other DNA
cttgattcagcagatgcggc

SEQ ID NO: 255 - DNA, 20 bp, synthetic construct
  misc_feature 1..20: note = Synthetic oligonucleotide
  source 1..20: mol_type = other DNA
gaaaaggctcgccctactgt

SEQ ID NO: 256 - DNA, 20 bp, synthetic construct
  misc_feature 1..20: note = Synthetic oligonucleotide
  source 1..20: mol_type = other DNA
gagtctcttcggctgtcatt

SEQ ID NO: 257 - DNA, 20 bp, synthetic construct
  misc_feature 1..20: note = Synthetic oligonucleotide
  source 1..20: mol_type = other DNA
tagaagggcccccgaccagg

SEQ ID NO: 258 - DNA, 20 bp, synthetic construct
  misc_feature 1..20: note = Synthetic oligonucleotide
  source 1..20: mol_type = other DNA
cacctttaaccatggtttac

SEQ ID NO: 259 - DNA, 20 bp, synthetic construct
  misc_feature 1..20: note = Synthetic oligonucleotide
  source 1..20: mol_type = other DNA
tcactttcatccacgacata

SEQ ID NO: 260 - DNA, 20 bp, synthetic construct
  misc_feature 1..20: note = Synthetic oligonucleotide
  source 1..20: mol_type = other DNA
gggagctccaatatcaaccg

SEQ ID NO: 261 - DNA, 20 bp, synthetic construct
  misc_feature 1..20: note = Synthetic oligonucleotide
  source 1..20: mol_type = other DNA
gggattcctcaggttcaacc

SEQ ID NO: 262 - DNA, 20 bp, synthetic construct
  misc_feature 1..20: note = Synthetic oligonucleotide
  source 1..20: mol_type = other DNA
gttaagctaaccagtgagac

SEQ ID NO: 263 - DNA, 20 bp, synthetic construct
  misc_feature 1..20: note = Synthetic oligonucleotide
  source 1..20: mol_type = other DNA
ctgtagttgttgaccacgct

SEQ ID NO: 264 - DNA, 20 bp, synthetic construct
  misc_feature 1..20: note = Synthetic oligonucleotide
  source 1..20: mol_type = other DNA
ggcagtttgattgctctcaa

SEQ ID NO: 265 - DNA, 20 bp, synthetic construct
  misc_feature 1..20: note = Synthetic oligonucleotide
  source 1..20: mol_type = other DNA
gtgaaatagtagtaacgaag

SEQ ID NO: 266 - DNA, 20 bp, synthetic construct
  misc_feature 1..20: note = Synthetic oligonucleotide
  source 1..20: mol_type = other DNA
ctttgatgggtgttccatca

SEQ ID NO: 267 - DNA, 20 bp, synthetic construct
  misc_feature 1..20: note = Synthetic oligonucleotide
  source 1..20: mol_type = other DNA
agacctcctgtgggagtcct

SEQ ID NO: 268 - DNA, 20 bp, synthetic construct
  misc_feature 1..20: note = Synthetic oligonucleotide
  source 1..20: mol_type = other DNA
tagaaacctcccatcgatac

SEQ ID NO: 269 - DNA, 20 bp, synthetic construct
  misc_feature 1..20: note = Synthetic oligonucleotide
  source 1..20: mol_type = other DNA
ctttaaattggttcctatcg

SEQ ID NO: 270 - DNA, 20 bp, synthetic construct
  misc_feature 1..20: note = Synthetic oligonucleotide
  source 1..20: mol_type = other DNA
gatagtcatgctgctgggac

SEQ ID NO: 271 - DNA, 20 bp, synthetic construct
  misc_feature 1..20: note = Synthetic oligonucleotide
  source 1..20: mol_type = other DNA
ggcttcccatattagacttc

SEQ ID NO: 272 - DNA, 20 bp, synthetic construct
  misc_feature 1..20: note = Synthetic oligonucleotide
  source 1..20: mol_type = other DNA
gtacagtcgggcttttcatc

SEQ ID NO: 273 - DNA, 20 bp, synthetic construct
  misc_feature 1..20: note = Synthetic oligonucleotide
  source 1..20: mol_type = other DNA
gccatatgggtcaataagat

SEQ ID NO: 274 - DNA, 20 bp, synthetic construct
  misc_feature 1..20: note = Synthetic oligonucleotide
  source 1..20: mol_type = other DNA
ggatcccatattatatctga

SEQ ID NO: 275 - DNA, 20 bp, synthetic construct
  misc_feature 1..20: note = Synthetic oligonucleotide
  source 1..20: mol_type = other DNA
gtaatgtggtttaccgttct

SEQ ID NO: 276 - DNA, 20 bp, synthetic construct
  misc_feature 1..20: note = Synthetic oligonucleotide
  source 1..20: mol_type = other DNA
ccactagtctacctgatgcc

SEQ ID NO: 277 - DNA, 20 bp, synthetic construct
  misc_feature 1..20: note = Synthetic oligonucleotide
  source 1..20: mol_type = other DNA
gtcattcgatggtacccaat

SEQ ID NO: 278 - DNA, 20 bp, synthetic construct
  misc_feature 1..20: note = Synthetic oligonucleotide
  source 1..20: mol_type = other DNA
cagtttggttgctacaatcc

SEQ ID NO: 279 - DNA, 20 bp, synthetic construct
  misc_feature 1..20: note = Synthetic oligonucleotide
  source 1..20: mol_type = other DNA
ccaatgatgtgctcggagcc

SEQ ID NO: 280 - DNA, 20 bp, synthetic construct
  misc_feature 1..20: note = Synthetic oligonucleotide
  source 1..20: mol_type = other DNA
gtaagtggcatcatccacac

SEQ ID NO: 281 - DNA, 20 bp, synthetic construct
  misc_feature 1..20: note = Synthetic oligonucleotide
  source 1..20: mol_type = other DNA
gagcactgaacagcatcccc

SEQ ID NO: 282 - DNA, 20 bp, synthetic construct
  misc_feature 1..20: note = Synthetic oligonucleotide
  source 1..20: mol_type = other DNA
ggcacttcattagtccagca

SEQ ID NO: 283 - DNA, 20 bp, synthetic construct
  misc_feature 1..20: note = Synthetic oligonucleotide
  source 1..20: mol_type = other DNA
tcgggacatagttatgttgt

SEQ ID NO: 284 - DNA, 20 bp, synthetic construct
  misc_feature 1..20: note = Synthetic oligonucleotide
  source 1..20: mol_type = other DNA
gttaagtaatggttggctct

SEQ ID NO: 285 - DNA, 20 bp, synthetic construct
  misc_feature 1..20: note = Synthetic oligonucleotide
  source 1..20: mol_type = other DNA
accacaagtttcaatgtgcc

SEQ ID NO: 286 - DNA, 20 bp, synthetic construct
  misc_feature 1..20: note = Synthetic oligonucleotide
  source 1..20: mol_type = other DNA
aactaatgaggtcctaggct

SEQ ID NO: 287 - DNA, 20 bp, synthetic construct
  misc_feature 1..20: note = Synthetic oligonucleotide
  source 1..20: mol_type = other DNA
gagccactgccatgttaatc

SEQ ID NO: 288 - DNA, 20 bp, synthetic construct
  misc_feature 1..20: note = Synthetic oligonucleotide
  source 1..20: mol_type = other DNA
cccggccatgacattgactc

SEQ ID NO: 289 - DNA, 20 bp, synthetic construct
  misc_feature 1..20: note = Synthetic oligonucleotide
  source 1..20: mol_type = other DNA
ggcaatagggtggtcatcag

SEQ ID NO: 290 - DNA, 20 bp, synthetic construct
  misc_feature 1..20: note = Synthetic oligonucleotide
  source 1..20: mol_type = other DNA
gtaggacatagttatgttgt

SEQ ID NO: 291 - DNA, 20 bp, synthetic construct
  misc_feature 1..20: note = Synthetic oligonucleotide
  source 1..20: mol_type = other DNA
tttccgaaagaacaccctca

SEQ ID NO: 292 - DNA, 20 bp, synthetic construct
  misc_feature 1..20: note = Synthetic oligonucleotide
  source 1..20: mol_type = other DNA
ccatcaagtttctggtaggg

SEQ ID NO: 293 - DNA, 20 bp, synthetic construct
  misc_feature 1..20: note = Synthetic oligonucleotide
  source 1..20: mol_type = other DNA
tgcccgcactccatggatca

SEQ ID NO: 294 - DNA, 20 bp, synthetic construct
  misc_feature 1..20: note = Synthetic oligonucleotide
  source 1..20: mol_type = other DNA
ctatggaggttgatagtggg

SEQ ID NO: 295 - DNA, 20 bp, synthetic construct
  misc_feature 1..20: note = Synthetic oligonucleotide
  source 1..20: mol_type = other DNA
ttggttacaccaagccaggc

SEQ ID NO: 296 - DNA, 20 bp, synthetic construct
  misc_feature 1..20: note = Synthetic oligonucleotide
  source 1..20: mol_type = other DNA
gtggtacaaattgctccagg

SEQ ID NO: 297 - DNA, 20 bp, synthetic construct
  misc_feature 1..20: note = Synthetic oligonucleotide
  source 1..20: mol_type = other DNA
gatggaagctaactccccct

SEQ ID NO: 298 - DNA, 20 bp, synthetic construct
  misc_feature 1..20: note = Synthetic oligonucleotide
  source 1..20: mol_type = other DNA
gatccctagtcctgagtgct

SEQ ID NO: 299 - DNA, 20 bp, synthetic construct
  misc_feature 1..20: note = Synthetic oligonucleotide
  source 1..20: mol_type = other DNA
acggtcaggtggttactaaa

SEQ ID NO: 300 - DNA, 20 bp, synthetic construct
  misc_feature 1..20: note = Synthetic oligonucleotide
  source 1..20: mol_type = other DNA
gtcctactgcaatcaagcgc

SEQ ID NO: 301 - DNA, 20 bp, synthetic construct
  misc_feature 1..20: note = Synthetic oligonucleotide
  source 1..20: mol_type = other DNA
gtagtgcactgcttaatggc

SEQ ID NO: 302 - DNA, 20 bp, synthetic construct
  misc_feature 1..20: note = Synthetic oligonucleotide
  source 1..20: mol_type = other DNA
gtgtagctcaataacttggt

SEQ ID NO: 303 - DNA, 20 bp, synthetic construct
  misc_feature 1..20: note = Synthetic oligonucleotide
  source 1..20: mol_type = other DNA
tactagtgtgatttggaggg

SEQ ID NO: 304 - DNA, 20 bp, synthetic construct
  misc_feature 1..20: note = Synthetic oligonucleotide
  source 1..20: mol_type = other DNA
atgctgcattatggactcgg

SEQ ID NO: 305 - DNA, 20 bp, synthetic construct
  misc_feature 1..20: note = Synthetic oligonucleotide
  source 1..20: mol_type = other DNA
cacttccaggttggtccccc

SEQ ID NO: 306 - DNA, 20 bp, synthetic construct
  misc_feature 1..20: note = Synthetic oligonucleotide
  source 1..20: mol_type = other DNA
gccaccctgtttaggtggca

SEQ ID NO: 307 - DNA, 20 bp, synthetic construct
  misc_feature 1..20: note = Synthetic oligonucleotide
  source 1..20: mol_type = other DNA
gctgccgcctagaagggcgc

SEQ ID NO: 308 - DNA, 20 bp, synthetic construct
  misc_feature 1..20: note = Synthetic oligonucleotide
  source 1..20: mol_type = other DNA
ccgatgaggctttgtttgga

SEQ ID NO: 309 - DNA, 20 bp, synthetic construct
  misc_feature 1..20: note = Synthetic oligonucleotide
  source 1..20: mol_type = other DNA
gcttcaagctggccccaact

SEQ ID NO: 310 - DNA, 20 bp, synthetic construct
  misc_feature 1..20: note = Synthetic oligonucleotide
  source 1..20: mol_type = other DNA
gcgcttctaactcaccctcc

SEQ ID NO: 311 - DNA, 20 bp, synthetic construct
  misc_feature 1..20: note = Synthetic oligonucleotide
  source 1..20: mol_type = other DNA
gcgcttgttactccctagga

SEQ ID NO: 312 - DNA, 20 bp, synthetic construct
  misc_feature 1..20: note = Synthetic oligonucleotide
  source 1..20: mol_type = other DNA
cgcccggctagatgtagggt

SEQ ID NO: 313 - DNA, 20 bp, synthetic construct
  misc_feature 1..20: note = Synthetic oligonucleotide
  source 1..20: mol_type = other DNA
gtaaccgtgtacagcctctg

SEQ ID NO: 314 - DNA, 20 bp, synthetic construct
  misc_feature 1..20: note = Synthetic oligonucleotide
  source 1..20: mol_type = other DNA
cagccccagtcaagataact

SEQ ID NO: 315 - DNA, 20 bp, synthetic construct
  misc_feature 1..20: note = Synthetic oligonucleotide
  source 1..20: mol_type = other DNA
ataggctccaccagtatgaa

SEQ ID NO: 316 - DNA, 20 bp, synthetic construct
  misc_feature 1..20: note = Synthetic oligonucleotide
  source 1..20: mol_type = other DNA
gtccactcagtctgccttat

SEQ ID NO: 317 - DNA, 20 bp, synthetic construct
  misc_feature 1..20: note = Synthetic oligonucleotide
  source 1..20: mol_type = other DNA
gtagcatagcccttgcctag

SEQ ID NO: 318 - DNA, 20 bp, synthetic construct
  misc_feature 1..20: note = Synthetic oligonucleotide
  source 1..20: mol_type = other DNA
gccatatggataatacacca

SEQ ID NO: 319 - DNA, 20 bp, synthetic construct
  misc_feature 1..20: note = Synthetic oligonucleotide
  source 1..20: mol_type = other DNA
attaggtgtgcccccccccc

SEQ ID NO: 320 - DNA, 20 bp, synthetic construct
  misc_feature 1..20: note = Synthetic oligonucleotide
  source 1..20: mol_type = other DNA
caatagcgaatcagtgtgaa

SEQ ID NO: 321 - DNA, 20 bp, synthetic construct
  misc_feature 1..20: note = Synthetic oligonucleotide
  source 1..20: mol_type = other DNA
cccgccctgcatgtcatgca

SEQ ID NO: 322 - DNA, 20 bp, synthetic construct
  misc_feature 1..20: note = Synthetic oligonucleotide
  source 1..20: mol_type = other DNA
actagactctggtagctcca

SEQ ID NO: 323 - DNA, 20 bp, synthetic construct
  misc_feature 1..20: note = Synthetic oligonucleotide
  source 1..20: mol_type = other DNA
tgaccaggactatcagagcc

SEQ ID NO: 324 - DNA, 20 bp, synthetic construct
  misc_feature 1..20: note = Synthetic oligonucleotide
  source 1..20: mol_type = other DNA
gttattcttacagcaggtcg

SEQ ID NO: 325 - DNA, 20 bp, synthetic construct
  misc_feature 1..20: note = Synthetic oligonucleotide
  source 1..20: mol_type = other DNA
ccacttgttttgaggcccct

SEQ ID NO: 326 - DNA, 20 bp, synthetic construct
  misc_feature 1..20: note = Synthetic oligonucleotide
  source 1..20: mol_type = other DNA
gtaaatagggaagctccatg

SEQ ID NO: 327 - DNA, 20 bp, synthetic construct
  misc_feature 1..20: note = Synthetic oligonucleotide
  source 1..20: mol_type = other DNA
gttacaatgttctattcgac

SEQ ID NO: 328 - DNA, 20 bp, synthetic construct
  misc_feature 1..20: note = Synthetic oligonucleotide
  source 1..20: mol_type = other DNA
gcagttaagctaaccagtga

SEQ ID NO: 329 - DNA, 20 bp, synthetic construct
  misc_feature 1..20: note = Synthetic oligonucleotide
  source 1..20: mol_type = other DNA
ttcctgtacagggactacaa

SEQ ID NO: 330 - DNA, 20 bp, synthetic construct
  misc_feature 1..20: note = Synthetic oligonucleotide
  source 1..20: mol_type = other DNA
cctggtaaagaagcggaagc

SEQ ID NO: 331 - DNA, 20 bp, synthetic construct
  misc_feature 1..20: note = Synthetic oligonucleotide
  source 1..20: mol_type = other DNA
atcctattagcgcaaacacg

SEQ ID NO: 332 - DNA, 20 bp, synthetic construct
  misc_feature 1..20: note = Synthetic oligonucleotide
  source 1..20: mol_type = other DNA
agtagtaccattcccatcca

SEQ ID NO: 333 - DNA, 20 bp, synthetic construct
  misc_feature 1..20: note = Synthetic oligonucleotide
  source 1..20: mol_type = other DNA
ctcttgattcagcagatgcg

SEQ ID NO: 334 - DNA, 20 bp, synthetic construct
  misc_feature 1..20: note = Synthetic oligonucleotide
  source 1..20: mol_type = other DNA
gctgaaaaggctcgccctac

SEQ ID NO: 335 - DNA, 20 bp, synthetic construct
  misc_feature 1..20: note = Synthetic oligonucleotide
  source 1..20: mol_type = other DNA
gagagtctcttcggctgtca

SEQ ID NO: 336 - DNA, 20 bp, synthetic construct
  misc_feature 1..20: note = Synthetic oligonucleotide
  source 1..20: mol_type = other DNA
gataagaactggaccgtctc

SEQ ID NO: 337 - DNA, 20 bp, synthetic construct
  misc_feature 1..20: note = Synthetic oligonucleotide
  source 1..20: mol_type = other DNA
ggtatggttggaaatacagc

SEQ ID NO: 338 - DNA, 20 bp, synthetic construct
  misc_feature 1..20: note = Synthetic oligonucleotide
  source 1..20: mol_type = other DNA
tatctgactcgctgctgaat

SEQ ID NO: 339 - DNA, 20 bp, synthetic construct
  misc_feature 1..20: note = Synthetic oligonucleotide
  source 1..20: mol_type = other DNA
ggcgggagctccaatatcaa

SEQ ID NO: 340 - DNA, 20 bp, synthetic construct
  misc_feature 1..20: note = Synthetic oligonucleotide
  source 1..20: mol_type = other DNA
tgaacttccgtacacagtct

SEQ ID NO: 341 - DNA, 20 bp, synthetic construct
  misc_feature 1..20: note = Synthetic oligonucleotide
  source 1..20: mol_type = other DNA
ctcactgtagttgttgacca

SEQ ID NO: 342 - DNA, 20 bp, synthetic construct
  misc_feature 1..20: note = Synthetic oligonucleotide
  source 1..20: mol_type = other DNA
cctggcagtttgattgctct

SEQ ID NO: 343 - DNA, 20 bp, synthetic construct
  misc_feature 1..20: note = Synthetic oligonucleotide
  source 1..20: mol_type = other DNA
tagtgaaatagtagtaacga

SEQ ID NO: 344 - DNA, 20 bp, synthetic construct
  misc_feature 1..20: note = Synthetic oligonucleotide
  source 1..20: mol_type = other DNA
cggttttctctggagttgaa

SEQ ID NO: 345 - DNA, 20 bp, synthetic construct
  misc_feature 1..20: note = Synthetic oligonucleotide
  source 1..20: mol_type = other DNA
ggcatagacctcctgtggga

SEQ ID NO: 346 - DNA, 20 bp, synthetic construct
  misc_feature 1..20: note = Synthetic oligonucleotide
  source 1..20: mol_type = other DNA
aatagaaacctcccatcgat

SEQ ID NO: 347 - DNA, 20 bp, synthetic construct
  misc_feature 1..20: note = Synthetic oligonucleotide
  source 1..20: mol_type = other DNA
cccccctttaaattggttcc

SEQ ID NO: 348 - DNA, 20 bp, synthetic construct
  misc_feature 1..20: note = Synthetic oligonucleotide
  source 1..20: mol_type = other DNA
ggtcaattcaggcttcttag

SEQ ID NO: 349 - DNA, 20 bp, synthetic construct
  misc_feature 1..20: note = Synthetic oligonucleotide
  source 1..20: mol_type = other DNA
tatggcttcccatattagac

SEQ ID NO: 350 - DNA, 20 bp, synthetic construct
  misc_feature 1..20: note = Synthetic oligonucleotide
  source 1..20: mol_type = other DNA
gtttgtacagtcgggctttt

SEQ ID NO: 351 - DNA, 20 bp, synthetic construct
  misc_feature 1..20: note = Synthetic oligonucleotide
  source 1..20: mol_type = other DNA
gtgccatatgggtcaataag

SEQ ID NO: 352 - DNA, 20 bp, synthetic construct
  misc_feature 1..20: note = Synthetic oligonucleotide
  source 1..20: mol_type = other DNA
ggtaatataacttcactacc

SEQ ID NO: 353 - DNA, 20 bp, synthetic construct
  misc_feature 1..20: note = Synthetic oligonucleotide
  source 1..20: mol_type = other DNA
gattgtaatgtggtttaccg

SEQ ID NO: 354 - DNA, 20 bp, synthetic construct
  misc_feature 1..20: note = Synthetic oligonucleotide
  source 1..20: mol_type = other DNA
ttccactagtctacctgatg

SEQ ID NO: 355 - DNA, 20 bp, synthetic construct
  misc_feature 1..20: note = Synthetic oligonucleotide
  source 1..20: mol_type = other DNA
cagtcattcgatggtaccca

SEQ ID NO: 356 - DNA, 20 bp, synthetic construct
  misc_feature 1..20: note = Synthetic oligonucleotide
  source 1..20: mol_type = other DNA
ttcagcagtttggttgctac

SEQ ID NO: 357 - DNA, 20 bp, synthetic construct
  misc_feature 1..20: note = Synthetic oligonucleotide
  source 1..20: mol_type = other DNA
tgccaatgatgtgctcggag

SEQ ID NO: 358 - DNA, 20 bp, synthetic construct
  misc_feature 1..20: note = Synthetic oligonucleotide
  source 1..20: mol_type = other DNA
ccgctgcagtaagtggcatc

SEQ ID NO: 359 - DNA, 20 bp, synthetic construct
  misc_feature 1..20: note = Synthetic oligonucleotide
  source 1..20: mol_type = other DNA
gtagtattcctccaatcact

SEQ ID NO: 360 - DNA, 20 bp, synthetic construct
  misc_feature 1..20: note = Synthetic oligonucleotide
  source 1..20: mol_type = other DNA
gagtggcacttcattagtcc

SEQ ID NO: 361 - DNA, 20 bp, synthetic construct
  misc_feature 1..20: note = Synthetic oligonucleotide
  source 1..20: mol_type = other DNA
agatcaattgaattgttggg

SEQ ID NO: 362 - DNA, 20 bp, synthetic construct
  misc_feature 1..20: note = Synthetic oligonucleotide
  source 1..20: mol_type = other DNA
caagttcaaatgtgtagtgc

SEQ ID NO: 363 - DNA, 20 bp, synthetic construct
  misc_feature 1..20: note = Synthetic oligonucleotide
  source 1..20: mol_type = other DNA
tcaggacaagctatcaagta

SEQ ID NO: 364 - DNA, 20 bp, synthetic construct
  misc_feature 1..20: note = Synthetic oligonucleotide
  source 1..20: mol_type = other DNA
attggcaggctatgcttaat

SEQ ID NO: 365 - DNA, 20 bp, synthetic construct
  misc_feature 1..20: note = Synthetic oligonucleotide
  source 1..20: mol_type = other DNA
atcctgatgcacctccaccg

SEQ ID NO: 366 - DNA, 20 bp, synthetic construct
  misc_feature 1..20: note = Synthetic oligonucleotide
  source 1..20: mol_type = other DNA
aagagccacggtggcccatc

SEQ ID NO: 367 - DNA, 20 bp, synthetic construct
  misc_feature 1..20: note = Synthetic oligonucleotide
  source 1..20: mol_type = other DNA
ggtggcttgagcagggtagc

SEQ ID NO: 368 - DNA, 20 bp, synthetic construct
  misc_feature 1..20: note = Synthetic oligonucleotide
  source 1..20: mol_type = other DNA
agcaagagggcaccgtttcc

SEQ ID NO: 369 - DNA, 20 bp, synthetic construct
  misc_feature 1..20: note = Synthetic oligonucleotide
  source 1..20: mol_type = other DNA
aactgcagttgatatacccc

SEQ ID NO: 370 - DNA, 20 bp, synthetic construct
  misc_feature 1..20: note = Synthetic oligonucleotide
  source 1..20: mol_type = other DNA
gcaagggagtccagttggat

SEQ ID NO: 371 - DNA, 20 bp, synthetic construct
  misc_feature 1..20: note = Synthetic oligonucleotide
  source 1..20: mol_type = other DNA
ggtgtaccccacttgaggtg

SEQ ID NO: 372 - DNA, 20 bp, synthetic construct
  misc_feature 1..20: note = Synthetic oligonucleotide
  source 1..20: mol_type = other DNA
ggctttcccggcccttactc

SEQ ID NO: 373 - DNA, 20 bp, synthetic construct
  misc_feature 1..20: note = Synthetic oligonucleotide
  source 1..20: mol_type = other DNA
ggtctgcaggtttgatccct

SEQ ID NO: 374 - DNA, 20 bp, synthetic construct
  misc_feature 1..20: note = Synthetic oligonucleotide
  source 1..20: mol_type = other DNA
attagttaccttggagggcc

SEQ ID NO: 375 - DNA, 20 bp, synthetic construct
  misc_feature 1..20: note = Synthetic oligonucleotide
  source 1..20: mol_type = other DNA
ccgtttgtttcccatccatc

SEQ ID NO: 376 - DNA, 20 bp, synthetic construct
  misc_feature 1..20: note = Synthetic oligonucleotide
  source 1..20: mol_type = other DNA
gcataggagaccatgggttc

SEQ ID NO: 377 - DNA, 20 bp, synthetic construct
  misc_feature 1..20: note = Synthetic oligonucleotide
  source 1..20: mol_type = other DNA
ggatggaataggttgtgcac

SEQ ID NO: 378 - DNA, 20 bp, synthetic construct
  misc_feature 1..20: note = Synthetic oligonucleotide
  source 1..20: mol_type = other DNA
gacagacaagtcccggtggc

SEQ ID NO: 379 - DNA, 20 bp, synthetic construct
  misc_feature 1..20: note = Synthetic oligonucleotide
  source 1..20: mol_type = other DNA
taccagctagcagactgccc

SEQ ID NO: 380 - DNA, 20 bp, synthetic construct
  misc_feature 1..20: note = Synthetic oligonucleotide
  source 1..20: mol_type = other DNA
cgtgtaaatgcccctgcccc

SEQ ID NO: 381 - DNA, 20 bp, synthetic construct
  misc_feature 1..20: note = Synthetic oligonucleotide
  source 1..20: mol_type = other DNA
ttacagcagttgctgctaga

SEQ ID NO: 382 - DNA, 20 bp, synthetic construct
  misc_feature 1..20: note = Synthetic oligonucleotide
  source 1..20: mol_type = other DNA
cgctaggaggtctgatccct

SEQ ID NO: 383 - DNA, 20 bp, synthetic construct
  misc_feature 1..20: note = Synthetic oligonucleotide
  source 1..20: mol_type = other DNA
atgcttggtctgtcaaggca

SEQ ID NO: 384 - DNA, 20 bp, synthetic construct
  misc_feature 1..20: note = Synthetic oligonucleotide
  source 1..20: mol_type = other DNA
tcaggcacctcgcatgtgag

SEQ ID NO: 385 - DNA, 20 bp, synthetic construct
  misc_feature 1..20: note = Synthetic oligonucleotide
  source 1..20: mol_type = other DNA
gaacaaccccgcaggtggcc

SEQ ID NO: 386 - DNA, 20 bp, synthetic construct
  misc_feature 1..20: note = Synthetic oligonucleotide
  source 1..20: mol_type = other DNA
gtgccctgtatctctgcggc

SEQ ID NO: 387 - DNA, 20 bp, synthetic construct
  misc_feature 1..20: note = Synthetic oligonucleotide
  source 1..20: mol_type = other DNA
ggagggaccaggtccactac

SEQ ID NO: 388 - DNA, 20 bp, synthetic construct
  misc_feature 1..20: note = Synthetic oligonucleotide
  source 1..20: mol_type = other DNA
atgtggccaccacctcttag

SEQ ID NO: 389 - DNA, 20 bp, synthetic construct
  misc_feature 1..20: note = Synthetic oligonucleotide
  source 1..20: mol_type = other DNA
gctctacctttaggcctatg

SEQ ID NO: 390 - DNA, 20 bp, synthetic construct
  misc_feature 1..20: note = Synthetic oligonucleotide
  source 1..20: mol_type = other DNA
gggcaagaattcactacctc

SEQ ID NO: 391 - DNA, 20 bp, synthetic construct
  misc_feature 1..20: note = Synthetic oligonucleotide
  source 1..20: mol_type = other DNA
tgtcaggctgaaagtagtgc

SEQ ID NO: 392 - DNA, 20 bp, synthetic construct
  misc_feature 1..20: note = Synthetic oligonucleotide
  source 1..20: mol_type = other DNA
gtaaccctatggcactttct

SEQ ID NO: 393 - DNA, 20 bp, synthetic construct
  misc_feature 1..20: note = Synthetic oligonucleotide
  source 1..20: mol_type = other DNA
ttgtagtgcctcctgcccac

SEQ ID NO: 394 - DNA, 20 bp, synthetic construct
  misc_feature 1..20: note = Synthetic oligonucleotide
  source 1..20: mol_type = other DNA
gtatgactcagcataatagc

SEQ ID NO: 395 - DNA, 20 bp, synthetic construct
  misc_feature 1..20: note = Synthetic oligonucleotide
  source 1..20: mol_type = other DNA
tgtaggttcaagatagtgct

SEQ ID NO: 396 - DNA, 20 bp, synthetic construct
  misc_feature 1..20: note = Synthetic oligonucleotide
  source 1..20: mol_type = other DNA
ggataatacaccaatatgga

SEQ ID NO: 397 - DNA, 20 bp, synthetic construct
  misc_feature 1..20: note = Synthetic oligonucleotide
  source 1..20: mol_type = other DNA
atgtacagttgttggatagg

SEQ ID NO: 398 - DNA, 20 bp, synthetic construct
  misc_feature 1..20: note = Synthetic oligonucleotide
  source 1..20: mol_type = other DNA
ggcaatagcgaatcagtgtg

SEQ ID NO: 399 - DNA, 20 bp, synthetic construct
  misc_feature 1..20: note = Synthetic oligonucleotide
  source 1..20: mol_type = other DNA
tataaggacctgtagtactt

SEQ ID NO: 400 - DNA, 20 bp, synthetic construct
  misc_feature 1..20: note = Synthetic oligonucleotide
  source 1..20: mol_type = other DNA
tctaacaggtggatatctca

SEQ ID NO: 401 - DNA, 20 bp, synthetic construct
  misc_feature 1..20: note = Synthetic oligonucleotide
  source 1..20: mol_type = other DNA
agctagctgctggtgctagg

SEQ ID NO: 402 - DNA, 20 bp, synthetic construct
  misc_feature 1..20: note = Synthetic oligonucleotide
  source 1..20: mol_type = other DNA
gcgattctcctggcagcaac

SEQ ID NO: 403 - DNA, 20 bp, synthetic construct
  misc_feature 1..20: note = Synthetic oligonucleotide
  source 1..20: mol_type = other DNA
tccaatggtgatttttggac

SEQ ID NO: 404 - DNA, 20 bp, synthetic construct
  misc_feature 1..20: note = Synthetic oligonucleotide
  source 1..20: mol_type = other DNA
gtaagtagtgtaaataggga

SEQ ID NO: 405 - DNA, 20 bp, synthetic construct
  misc_feature 1..20: note = Synthetic oligonucleotide
  source 1..20: mol_type = other DNA
ttaatgctacctcatagcac

SEQ ID NO: 406 - DNA, 20 bp, synthetic construct
  misc_feature 1..20: note = Synthetic oligonucleotide
  source 1..20: mol_type = other DNA
gtcaaccttaccaagagcag

SEQ ID NO: 407 - DNA, 20 bp, synthetic construct
  misc_feature 1..20: note = Synthetic oligonucleotide
  source 1..20: mol_type = other DNA
atttcctgtacagggactac

SEQ ID NO: 408 - DNA, 20 bp, synthetic construct
  misc_feature 1..20: note = Synthetic oligonucleotide
  source 1..20: mol_type = other DNA
attccctggtaaagaagcgg

SEQ ID NO: 409 - DNA, 20 bp, synthetic construct
  misc_feature 1..20: note = Synthetic oligonucleotide
  source 1..20: mol_type = other DNA
gcaatcctattagcgcaaac

SEQ ID NO: 410 - DNA, 20 bp, synthetic construct
  misc_feature 1..20: note = Synthetic oligonucleotide
  source 1..20: mol_type = other DNA
cctattgaaagtagtaccat

SEQ ID NO: 411 - DNA, 20 bp, synthetic construct
  misc_feature 1..20: note = Synthetic oligonucleotide
  source 1..20: mol_type = other DNA
ccgattttcggactctgtca

SEQ ID NO: 412 - DNA, 20 bp, synthetic construct
  misc_feature 1..20: note = Synthetic oligonucleotide
  source 1..20: mol_type = other DNA
gccaatgtcctttgctcgac

SEQ ID NO: 413 - DNA, 20 bp, synthetic construct
  misc_feature 1..20: note = Synthetic oligonucleotide
  source 1..20: mol_type = other DNA
cagagagtctcttcggctgt

SEQ ID NO: 414 - DNA, 20 bp, synthetic construct
  misc_feature 1..20: note = Synthetic oligonucleotide
  source 1..20: mol_type = other DNA
gccttgatgtaggatcttcc

SEQ ID NO: 415 - DNA, 20 bp, synthetic construct
  misc_feature 1..20: note = Synthetic oligonucleotide
  source 1..20: mol_type = other DNA
ggtggtatggttggaaatac

SEQ ID NO: 416 - DNA, 20 bp, synthetic construct
  misc_feature 1..20: note = Synthetic oligonucleotide
  source 1..20: mol_type = other DNA
ccatatctgactcgctgctg

SEQ ID NO: 417 - DNA, 20 bp, synthetic construct
  misc_feature 1..20: note = Synthetic oligonucleotide
  source 1..20: mol_type = other DNA
tcggcgggagctccaatatc

SEQ ID NO: 418 - DNA, 20 bp, synthetic construct
  misc_feature 1..20: note = Synthetic oligonucleotide
  source 1..20: mol_type = other DNA
cttgaacttccgtacacagt

SEQ ID NO: 419 - DNA, 20 bp, synthetic construct
  misc_feature 1..20: note = Synthetic oligonucleotide
  source 1..20: mol_type = other DNA
ccacgcttacatcaaacatc

SEQ ID NO: 420 - DNA, 20 bp, synthetic construct
  misc_feature 1..20: note = Synthetic oligonucleotide
  source 1..20: mol_type = other DNA
gcactcactgtagttgttga

SEQ ID NO: 421 - DNA, 20 bp, synthetic construct
  misc_feature 1..20: note = Synthetic oligonucleotide
  source 1..20: mol_type = other DNA
acagatatccaagtcctacg

SEQ ID NO: 422 - DNA, 20 bp, synthetic construct
  misc_feature 1..20: note = Synthetic oligonucleotide
  source 1..20: mol_type = other DNA
gccctctggataataatagc

SEQ ID NO: 423 - DNA, 20 bp, synthetic construct
  misc_feature 1..20: note = Synthetic oligonucleotide
  source 1..20: mol_type = other DNA
gtcatatcggttttctctgg

SEQ ID NO: 424 - DNA, 20 bp, synthetic construct
  misc_feature 1..20: note = Synthetic oligonucleotide
  source 1..20: mol_type = other DNA
catcgatactatttctccag

SEQ ID NO: 425 - DNA, 20 bp, synthetic construct
  misc_feature 1..20: note = Synthetic oligonucleotide
  source 1..20: mol_type = other DNA
agccattacgcctctgctct

SEQ ID NO: 426 - DNA, 20 bp, synthetic construct
  misc_feature 1..20: note = Synthetic oligonucleotide
  source 1..20: mol_type = other DNA
cctcccccctttaaattggt

SEQ ID NO: 427 - DNA, 20 bp, synthetic construct
  misc_feature 1..20: note = Synthetic oligonucleotide
  source 1..20: mol_type = other DNA
gaatgaggtcttggtagaac

SEQ ID NO: 428 - DNA, 20 bp, synthetic construct
  misc_feature 1..20: note = Synthetic oligonucleotide
  source 1..20: mol_type = other DNA
gcaacatgtttgtacagtcg

SEQ ID NO: 429 - DNA, 20 bp, synthetic construct
  misc_feature 1..20: note = Synthetic oligonucleotide
  source 1..20: mol_type = other DNA
ctagtgccatatgggtcaat

SEQ ID NO: 430 - DNA, 20 bp, synthetic construct
  misc_feature 1..20: note = Synthetic oligonucleotide
  source 1..20: mol_type = other DNA
cgttctttatggtaacagca

SEQ ID NO: 431 - DNA, 20 bp, synthetic construct
  misc_feature 1..20: note = Synthetic oligonucleotide
  source 1..20: mol_type = other DNA
ggcttgattgtaatgtggtt

SEQ ID NO: 432 - DNA, 20 bp, synthetic construct
  misc_feature 1..20: note = Synthetic oligonucleotide
  source 1..20: mol_type = other DNA
gtaactttccactagtctac

SEQ ID NO: 433 - DNA, 20 bp, synthetic construct
  misc_feature 1..20: note = Synthetic oligonucleotide
  source 1..20: mol_type = other DNA
tctgacagtcattcgatggt

SEQ ID NO: 434 - DNA, 20 bp, synthetic construct
  misc_feature 1..20: note = Synthetic oligonucleotide
  source 1..20: mol_type = other DNA
cgccagtcttcagcagtttg

SEQ ID NO: 435 - DNA, 20 bp, synthetic construct
  misc_feature 1..20: note = Synthetic oligonucleotide
  source 1..20: mol_type = other DNA
ggtgccaatgatgtgctcgg

SEQ ID NO: 436 - DNA, 20 bp, synthetic construct
  misc_feature 1..20: note = Synthetic oligonucleotide
  source 1..20: mol_type = other DNA
tccccgctgcagtaagtggc

SEQ ID NO: 437 - DNA, 20 bp, synthetic construct
  misc_feature 1..20: note = Synthetic oligonucleotide
  source 1..20: mol_type = other DNA
cagtagtattcctccaatca

SEQ ID NO: 438 - DNA, 20 bp, synthetic construct
  misc_feature 1..20: note = Synthetic oligonucleotide
  source 1..20: mol_type = other DNA
gtggagtggcacttcattag

SEQ ID NO: 439 - DNA, 20 bp, synthetic construct
  misc_feature 1..20: note = Synthetic oligonucleotide
  source 1..20: mol_type = other DNA
gttaagtaatggttggcacc

SEQ ID NO: 440 - DNA, 20 bp, synthetic construct
  misc_feature 1..20: note = Synthetic oligonucleotide
  source 1..20: mol_type = other DNA
gtcaagtttttgaactgacc

SEQ ID NO: 441 - DNA, 20 bp, synthetic construct
  misc_feature 1..20: note = Synthetic oligonucleotide
  source 1..20: mol_type = other DNA
gatcaggacaagctatcaag

SEQ ID NO: 442 - DNA, 20 bp, synthetic construct
  misc_feature 1..20: note = Synthetic oligonucleotide
  source 1..20: mol_type = other DNA
gttacaaaagtagggactca

SEQ ID NO: 443 - DNA, 20 bp, synthetic construct
  misc_feature 1..20: note = Synthetic oligonucleotide
  source 1..20: mol_type = other DNA
gtctatgccatcctgatatg

SEQ ID NO: 444 - DNA, 20 bp, synthetic construct
  misc_feature 1..20: note = Synthetic oligonucleotide
  source 1..20: mol_type = other DNA
gagggatagtgtcagtcttc

SEQ ID NO: 445 - DNA, 20 bp, synthetic construct
  misc_feature 1..20: note = Synthetic oligonucleotide
  source 1..20: mol_type = other DNA
aggaggttagtcatgcaagt

SEQ ID NO: 446 - DNA, 20 bp, synthetic construct
  misc_feature 1..20: note = Synthetic oligonucleotide
  source 1..20: mol_type = other DNA
gagtgcaccccaaggctagc

SEQ ID NO: 447 - DNA, 20 bp, synthetic construct
  misc_feature 1..20: note = Synthetic oligonucleotide
  source 1..20: mol_type = other DNA
gagttaaaccatagagccat

SEQ ID NO: 448 - DNA, 20 bp, synthetic construct
  misc_feature 1..20: note = Synthetic oligonucleotide
  source 1..20: mol_type = other DNA
tcccatggttggtcctagcc

SEQ ID NO: 449 - DNA, 20 bp, synthetic construct
  misc_feature 1..20: note = Synthetic oligonucleotide
  source 1..20: mol_type = other DNA
atccagaccgtattgcaacc

SEQ ID NO: 450 - DNA, 20 bp, synthetic construct
  misc_feature 1..20: note = Synthetic oligonucleotide
  source 1..20: mol_type = other DNA
ctacccagtagcccctggta

SEQ ID NO: 451 - DNA, 20 bp, synthetic construct
  misc_feature 1..20: note = Synthetic oligonucleotide
  source 1..20: mol_type = other DNA
gttggcactataaccaatgc

SEQ ID NO: 452 - DNA, 20 bp, synthetic construct
  misc_feature 1..20: note = Synthetic oligonucleotide
  source 1..20: mol_type = other DNA
tgctctgtcgacacctgtct

SEQ ID NO: 453 - DNA, 20 bp, synthetic construct
  misc_feature 1..20: note = Synthetic oligonucleotide
  source 1..20: mol_type = other DNA
caccggcacttcagacttgg

SEQ ID NO: 454 - DNA, 20 bp, synthetic construct
  misc_feature 1..20: note = Synthetic oligonucleotide
  source 1..20: mol_type = other DNA
gtagatctgaatgtctgggc

SEQ ID NO: 455 - DNA, 20 bp, synthetic construct
  misc_feature 1..20: note = Synthetic oligonucleotide
  source 1..20: mol_type = other DNA
ttaggacaagctatcaccag

SEQ ID NO: 456 - DNA, 20 bp, synthetic construct
  misc_feature 1..20: note = Synthetic oligonucleotide
  source 1..20: mol_type = other DNA
gtagcagctctagcctccca

SEQ ID NO: 457 - DNA, 20 bp, synthetic construct
  misc_feature 1..20: note = Synthetic oligonucleotide
  source 1..20: mol_type = other DNA
gtagctcggaccccctggct

SEQ ID NO: 458 - DNA, 20 bp, synthetic construct
  misc_feature 1..20: note = Synthetic oligonucleotide
  source 1..20: mol_type = other DNA
tcatcattcagatgcacgac

SEQ ID NO: 459 - DNA, 20 bp, synthetic construct
  misc_feature 1..20: note = Synthetic oligonucleotide
  source 1..20: mol_type = other DNA
ggtctaaactctggtgctat

SEQ ID NO: 460 - DNA, 20 bp, synthetic construct
  misc_feature 1..20: note = Synthetic oligonucleotide
  source 1..20: mol_type = other DNA
ggatggttcctccccttagc

SEQ ID NO: 461 - DNA, 20 bp, synthetic construct
  misc_feature 1..20: note = Synthetic oligonucleotide
  source 1..20: mol_type = other DNA
atttcatgagtgtcgccatc

SEQ ID NO: 462 - DNA, 20 bp, synthetic construct
  misc_feature 1..20: note = Synthetic oligonucleotide
  source 1..20: mol_type = other DNA
tcaataacggcaagtctgct

SEQ ID NO: 463 - DNA, 20 bp, synthetic construct
  misc_feature 1..20: note = Synthetic oligonucleotide
  source 1..20: mol_type = other DNA
taggtattaaggtttcactc

SEQ ID NO: 464 - DNA, 20 bp, synthetic construct
  misc_feature 1..20: note = Synthetic oligonucleotide
  source 1..20: mol_type = other DNA
gaggctcgggtctcccagtg

SEQ ID NO: 465 - DNA, 20 bp, synthetic construct
  misc_feature 1..20: note = Synthetic oligonucleotide
  source 1..20: mol_type = other DNA
atccatgagttatgcacgga

SEQ ID NO: 466 - DNA, 20 bp, synthetic construct
  misc_feature 1..20: note = Synthetic oligonucleotide
  source 1..20: mol_type = other DNA
gatatctcaggagatgtcct

SEQ ID NO: 467 - DNA, 20 bp, synthetic construct
  misc_feature 1..20: note = Synthetic oligonucleotide
  source 1..20: mol_type = other DNA
gtggtaactctaccccaaac

SEQ ID NO: 468 - DNA, 20 bp, synthetic construct
  misc_feature 1..20: note = Synthetic oligonucleotide
  source 1..20: mol_type = other DNA
aggtggttacctcagagacc

SEQ ID NO: 469 - DNA, 20 bp, synthetic construct
  misc_feature 1..20: note = Synthetic oligonucleotide
  source 1..20: mol_type = other DNA
gtgacttgctaccatagagc

SEQ ID NO: 470 - DNA, 20 bp, synthetic construct
  misc_feature 1..20: note = Synthetic oligonucleotide
  source 1..20: mol_type = other DNA
ctaggctggcagtcccatcc

SEQ ID NO: 471 - DNA, 20 bp, synthetic construct
  misc_feature 1..20: note = Synthetic oligonucleotide
  source 1..20: mol_type = other DNA
gcaactaccctctcatcaga

SEQ ID NO: 472 - DNA, 20 bp, synthetic construct
  misc_feature 1..20: note = Synthetic oligonucleotide
  source 1..20: mol_type = other DNA
cccatgctgctagcaactga

SEQ ID NO: 473 - DNA, 20 bp, synthetic construct
  misc_feature 1..20: note = Synthetic oligonucleotide
  source 1..20: mol_type = other DNA
agttatagcgaatcagtggt

SEQ ID NO: 474 - DNA, 20 bp, synthetic construct
  misc_feature 1..20: note = Synthetic oligonucleotide
  source 1..20: mol_type = other DNA
gccctatggataatacacca

SEQ ID NO: 475 - DNA, 20 bp, synthetic construct
  misc_feature 1..20: note = Synthetic oligonucleotide
  source 1..20: mol_type = other DNA
ctccagtgacatattgcccc

SEQ ID NO: 476 - DNA, 20 bp, synthetic construct
  misc_feature 1..20: note = Synthetic oligonucleotide
  source 1..20: mol_type = other DNA
ttcgccttagaggcctccag

SEQ ID NO: 477 - DNA, 20 bp, synthetic construct
  misc_feature 1..20: note = Synthetic oligonucleotide
  source 1..20: mol_type = other DNA
catacagttgactaatgtag

SEQ ID NO: 478 - DNA, 20 bp, synthetic construct
  misc_feature 1..20: note = Synthetic oligonucleotide
  source 1..20: mol_type = other DNA
tctgttgtgcggacatagta

SEQ ID NO: 479 - DNA, 20 bp, synthetic construct
  misc_feature 1..20: note = Synthetic oligonucleotide
  source 1..20: mol_type = other DNA
tttgcagcggaaaaggtctg

SEQ ID NO: 480 - DNA, 20 bp, synthetic construct
  misc_feature 1..20: note = Synthetic oligonucleotide
  source 1..20: mol_type = other DNA
caggtcgaggtatgggttat

SEQ ID NO: 481 - DNA, 20 bp, synthetic construct
  misc_feature 1..20: note = Synthetic oligonucleotide
  source 1..20: mol_type = other DNA
tagaatgactaatactctgc

SEQ ID NO: 482 - DNA, 20 bp, synthetic construct
  misc_feature 1..20: note = Synthetic oligonucleotide
  source 1..20: mol_type = other DNA
ggtaagtagtgtaaataggg

SEQ ID NO: 483 - DNA, 20 bp, synthetic construct
  misc_feature 1..20: note = Synthetic oligonucleotide
  source 1..20: mol_type = other DNA
gactcaaccctggaaggtcc

SEQ ID NO: 484 - DNA, 20 bp, synthetic construct
  misc_feature 1..20: note = Synthetic oligonucleotide
  source 1..20: mol_type = other DNA
gctttctgttctgacagtca

SEQ ID NO: 485 - DNA, 20 bp, synthetic construct
  misc_feature 1..20: note = Synthetic oligonucleotide
  source 1..20: mol_type = other DNA
ttgggtctcttagctttctc

SEQ ID NO: 486 - DNA, 20 bp, synthetic construct
  misc_feature 1..20: note = Synthetic oligonucleotide
  source 1..20: mol_type = other DNA
tgcaagtattttaataagtg

SEQ ID NO: 487 - DNA, 20 bp, synthetic construct
  misc_feature 1..20: note = Synthetic oligonucleotide
  source 1..20: mol_type = other DNA
acagatgtatccttcaggac

SEQ ID NO: 488 - DNA, 20 bp, synthetic construct
  misc_feature 1..20: note = Synthetic oligonucleotide
  source 1..20: mol_type = other DNA
aacatgataagaactggacc

SEQ ID NO: 489 - DNA, 20 bp, synthetic construct
  misc_feature 1..20: note = Synthetic oligonucleotide
  source 1..20: mol_type = other DNA
aaatgggtccattacaacca

SEQ ID NO: 490 - DNA, 20 bp, synthetic construct
  misc_feature 1..20: note = Synthetic oligonucleotide
  source 1..20: mol_type = other DNA
gtggtatggttggaaataca

SEQ ID NO: 491 - DNA, 20 bp, synthetic construct
  misc_feature 1..20: note = Synthetic oligonucleotide
  source 1..20: mol_type = other DNA
cagcatattctaacatggtc

SEQ ID NO: 492 - DNA, 20 bp, synthetic construct
  misc_feature 1..20: note = Synthetic oligonucleotide
  source 1..20: mol_type = other DNA
aatatccatccatcccttaa

SEQ ID NO: 493 - DNA, 20 bp, synthetic construct
  misc_feature 1..20: note = Synthetic oligonucleotide
  source 1..20: mol_type = other DNA
gagttgaattctcattcagt

SEQ ID NO: 494 - DNA, 20 bp, synthetic construct
  misc_feature 1..20: note = Synthetic oligonucleotide
  source 1..20: mol_type = other DNA
tgtgatttttttatgtgtga

SEQ ID NO: 495 - DNA, 20 bp, synthetic construct
  misc_feature 1..20: note = Synthetic oligonucleotide
  source 1..20: mol_type = other DNA
ataggatatttttattttat

SEQ ID NO: 496 - DNA, 20 bp, synthetic construct
  misc_feature 1..20: note = Synthetic oligonucleotide
  source 1..20: mol_type = other DNA
actgggtaaaattactattt

SEQ ID NO: 497 - DNA, 20 bp, synthetic construct
  misc_feature 1..20: note = Synthetic oligonucleotide
  source 1..20: mol_type = other DNA
ataatggaaccaattacatc

SEQ ID NO: 498 - DNA, 20 bp, synthetic construct
  misc_feature 1..20: note = Synthetic oligonucleotide
  source 1..20: mol_type = other DNA
tattttcttagaaaactcta

SEQ ID NO: 499 - DNA, 20 bp, synthetic construct
  misc_feature 1..20: note = Synthetic oligonucleotide
  source 1..20: mol_type = other DNA
aagcagaaacctacactgca

SEQ ID NO: 500 - DNA, 20 bp, synthetic construct
  misc_feature 1..20: note = Synthetic oligonucleotide
  source 1..20: mol_type = other DNA
ttgtgaaacacaaagtattt

SEQ ID NO: 501 - DNA, 20 bp, synthetic construct
  misc_feature 1..20: note = Synthetic oligonucleotide
  source 1..20: mol_type = other DNA
aacaattaaatacaaaaaca

SEQ ID NO: 502 - DNA, 20 bp, synthetic construct
  misc_feature 1..20: note = Synthetic oligonucleotide
  source 1..20: mol_type = other DNA
attaacttccattccatgaa

SEQ ID NO: 503 - DNA, 20 bp, synthetic construct
  misc_feature 1..20: note = Synthetic oligonucleotide
  source 1..20: mol_type = other DNA
gttagtcaattttttattaa

SEQ ID NO: 504 - DNA, 20 bp, synthetic construct
  misc_feature 1..20: note = Synthetic oligonucleotide
  source 1..20: mol_type = other DNA
atgacacattttaatccctt

SEQ ID NO: 505 - DNA, 20 bp, synthetic construct
  misc_feature 1..20: note = Synthetic oligonucleotide
  source 1..20: mol_type = other DNA
taacaacttaaaactataaa

SEQ ID NO: 506 - DNA, 20 bp, synthetic construct
  misc_feature 1..20: note = Synthetic oligonucleotide
  source 1..20: mol_type = other DNA
aaccatcacatcttttagaa

SEQ ID NO: 507 - DNA, 20 bp, synthetic construct
  misc_feature 1..20: note = Synthetic oligonucleotide
  source 1..20: mol_type = other DNA
ataaaacatacaactactta

SEQ ID NO: 508 - DNA, 20 bp, synthetic construct
  misc_feature 1..20: note = Synthetic oligonucleotide
  source 1..20: mol_type = other DNA
ccatattttaataattgtta

SEQ ID NO: 509 - DNA, 20 bp, synthetic construct
  misc_feature 1..20: note = Synthetic oligonucleotide
  source 1..20: mol_type = other DNA
gtatcccatttattgagtta

SEQ ID NO: 510 - DNA, 20 bp, synthetic construct
  misc_feature 1..20: note = Synthetic oligonucleotide
  source 1..20: mol_type = other DNA
aaacttttttatactagtta

SEQ ID NO: 511 - DNA, 20 bp, synthetic construct
  misc_feature 1..20: note = Synthetic oligonucleotide
  source 1..20: mol_type = other DNA
cttattcaactctttaatca

SEQ ID NO: 512 - DNA, 20 bp, synthetic construct
  misc_feature 1..20: note = Synthetic oligonucleotide
  source 1..20: mol_type = other DNA
gctcatattataaatatatt

SEQ ID NO: 513 - DNA, 20 bp, synthetic construct
  misc_feature 1..20: note = Synthetic oligonucleotide
  source 1..20: mol_type = other DNA
gtttgtttcccatccatcta

SEQ ID NO: 514 - DNA, 20 bp, synthetic construct
  misc_feature 1..20: note = Synthetic oligonucleotide
  source 1..20: mol_type = other DNA
acatctctcctcatattcat

SEQ ID NO: 515 - DNA, 20 bp, synthetic construct
  misc_feature 1..20: note = Synthetic oligonucleotide
  source 1..20: mol_type = other DNA
tctgatatttctataatgtt

SEQ ID NO: 516 - DNA, 20 bp, synthetic construct
  misc_feature 1..20: note = Synthetic oligonucleotide
  source 1..20: mol_type = other DNA
ttataataccatatttttta

SEQ ID NO: 517 - DNA, 20 bp, synthetic construct
  misc_feature 1..20: note = Synthetic oligonucleotide
  source 1..20: mol_type = other DNA
tatgtatatttattttccaa

SEQ ID NO: 518 - DNA, 20 bp, synthetic construct
  misc_feature 1..20: note = Synthetic oligonucleotide
  source 1..20: mol_type = other DNA
atctgattctctaatctctg

SEQ ID NO: 519 - DNA, 20 bp, synthetic construct
  misc_feature 1..20: note = Synthetic oligonucleotide
  source 1..20: mol_type = other DNA
aatcagttactaactacagc

SEQ ID NO: 520 - DNA, 20 bp, synthetic construct
  misc_feature 1..20: note = Synthetic oligonucleotide
  source 1..20: mol_type = other DNA
ccattttcctaccattttca

SEQ ID NO: 521 - DNA, 20 bp, synthetic construct
  misc_feature 1..20: note = Synthetic oligonucleotide
  source 1..20: mol_type = other DNA
cagatacatcccttaccagc

SEQ ID NO: 522 - DNA, 20 bp, synthetic construct
  misc_feature 1..20: note = Synthetic oligonucleotide
  source 1..20: mol_type = other DNA
agagaaataattattttcta

SEQ ID NO: 523 - DNA, 20 bp, synthetic construct
  misc_feature 1..20: note = Synthetic oligonucleotide
  source 1..20: mol_type = other DNA
tctccagtttcattttcttt

SEQ ID NO: 524 - DNA, 20 bp, synthetic construct
  misc_feature 1..20: note = Synthetic oligonucleotide
  source 1..20: mol_type = other DNA
acataaccattatataccca

SEQ ID NO: 525 - DNA, 20 bp, synthetic construct
  misc_feature 1..20: note = Synthetic oligonucleotide
  source 1..20: mol_type = other DNA
cctaatgtttttactataaa

SEQ ID NO: 526 - DNA, 20 bp, synthetic construct
  misc_feature 1..20: note = Synthetic oligonucleotide
  source 1..20: mol_type = other DNA
atttatcaacttaaattttc

SEQ ID NO: 527 - DNA, 20 bp, synthetic construct
  misc_feature 1..20: note = Synthetic oligonucleotide
  source 1..20: mol_type = other DNA
atattgcattttccacatta

SEQ ID NO: 528 - DNA, 20 bp, synthetic construct
  misc_feature 1..20: note = Synthetic oligonucleotide
  source 1..20: mol_type = other DNA
ttaaatcatcttaaattagt

SEQ ID NO: 529 - DNA, 20 bp, synthetic construct
  misc_feature 1..20: note = Synthetic oligonucleotide
  source 1..20: mol_type = other DNA
atctagtttttatttttaag

SEQ ID NO: 530 - DNA, 20 bp, synthetic construct
  misc_feature 1..20: note = Synthetic oligonucleotide
  source 1..20: mol_type = other DNA
aatatgctaaatactcccca

SEQ ID NO: 531 - DNA, 20 bp, synthetic construct
  misc_feature 1..20: note = Synthetic oligonucleotide
  source 1..20: mol_type = other DNA
aacttgctaatcttcaggca

SEQ ID NO: 532 - DNA, 20 bp, synthetic construct
  misc_feature 1..20: note = Synthetic oligonucleotide
  source 1..20: mol_type = other DNA
attccattttcacacaataa

SEQ ID NO: 533 - DNA, 20 bp, synthetic construct
  misc_feature 1..20: note = Synthetic oligonucleotide
  source 1..20: mol_type = other DNA
cctatgttaaatttgaatta

SEQ ID NO: 534 - DNA, 20 bp, synthetic construct
  misc_feature 1..20: note = Synthetic oligonucleotide
  source 1..20: mol_type = other DNA
ttaaacctcttcctttgcca

SEQ ID NO: 535 - DNA, 20 bp, synthetic construct
  misc_feature 1..20: note = Synthetic oligonucleotide
  source 1..20: mol_type = other DNA
aagcagttaatataatccaa

SEQ ID NO: 536 - DNA, 20 bp, synthetic construct
  misc_feature 1..20: note = Synthetic oligonucleotide
  source 1..20: mol_type = other DNA
atattgataatatttattaa

SEQ ID NO: 537 - DNA, 20 bp, synthetic construct
  misc_feature 1..20: note = Synthetic oligonucleotide
  source 1..20: mol_type = other DNA
aaccttatatttacattgaa

SEQ ID NO: 538 - DNA, 20 bp, synthetic construct
  misc_feature 1..20: note = Synthetic oligonucleotide
  source 1..20: mol_type = other DNA
tttcttctttttaaatccat

SEQ ID NO: 539 - DNA, 20 bp, synthetic construct
  misc_feature 1..20: note = Synthetic oligonucleotide
  source 1..20: mol_type = other DNA
aacaaagttccatctctcta

SEQ ID NO: 540 - DNA, 20 bp, synthetic construct
  misc_feature 1..20: note = Synthetic oligonucleotide
  source 1..20: mol_type = other DNA
tgagaacctgaatctagcca

SEQ ID NO: 541 - DNA, 20 bp, synthetic construct
  misc_feature 1..20: note = Synthetic oligonucleotide
  source 1..20: mol_type = other DNA
ctaaaaatctaaatatgtta

SEQ ID NO: 542 - DNA, 20 bp, synthetic construct
  misc_feature 1..20: note = Synthetic oligonucleotide
  source 1..20: mol_type = other DNA
actcctttttcaatatgtct

SEQ ID NO: 543 - DNA, 20 bp, synthetic construct
  misc_feature 1..20: note = Synthetic oligonucleotide
  source 1..20: mol_type = other DNA
actaacattttataaggtaa

SEQ ID NO: 544 - DNA, 20 bp, synthetic construct
  misc_feature 1..20: note = Synthetic oligonucleotide
  source 1..20: mol_type = other DNA
tctctagaaatacataccca

SEQ ID NO: 545 - DNA, 20 bp, synthetic construct
  misc_feature 1..20: note = Synthetic oligonucleotide
  source 1..20: mol_type = other DNA
ctatttcccttaactgcatc

SEQ ID NO: 546 - DNA, 20 bp, synthetic construct
  misc_feature 1..20: note = Synthetic oligonucleotide
  source 1..20: mol_type = other DNA
atgaaatcaaatctataaca

SEQ ID NO: 547 - DNA, 20 bp, synthetic construct
  misc_feature 1..20: note = Synthetic oligonucleotide
  source 1..20: mol_type = other DNA
tactctatttacaaatgtca

SEQ ID NO: 548 - DNA, 20 bp, synthetic construct
  misc_feature 1..20: note = Synthetic oligonucleotide
  source 1..20: mol_type = other DNA
tctgaatttcccattaaaca

SEQ ID NO: 549 - DNA, 20 bp, synthetic construct
  misc_feature 1..20: note = Synthetic oligonucleotide
  source 1..20: mol_type = other DNA
aaattatattctaaatacaa

SEQ ID NO: 550 - DNA, 20 bp, synthetic construct
  misc_feature 1..20: note = Synthetic oligonucleotide
  source 1..20: mol_type = other DNA
ataacatcaattaaatgact

SEQ ID NO: 551 - DNA, 20 bp, synthetic construct
  misc_feature 1..20: note = Synthetic oligonucleotide
  source 1..20: mol_type = other DNA
ccatatggataatacaccaa

SEQ ID NO: 552 - DNA, 20 bp, synthetic construct
  misc_feature 1..20: note = Synthetic oligonucleotide
  source 1..20: mol_type = other DNA
aatatattctataattttct

SEQ ID NO: 553 - DNA, 20 bp, synthetic construct
  misc_feature 1..20: note = Synthetic oligonucleotide
  source 1..20: mol_type = other DNA
tggcaatagcgaatcagtgt

SEQ ID NO: 554 - DNA, 20 bp, synthetic construct
  misc_feature 1..20: note = Synthetic oligonucleotide
  source 1..20: mol_type = other DNA
cttgagattttaaatattaa

SEQ ID NO: 555 - DNA, 20 bp, synthetic construct
  misc_feature 1..20: note = Synthetic oligonucleotide
  source 1..20: mol_type = other DNA
cttttgtaccacccttctaa

SEQ ID NO: 556 - DNA, 20 bp, synthetic construct
  misc_feature 1..20: note = Synthetic oligonucleotide
  source 1..20: mol_type = other DNA
taatgcttcctttctactta

SEQ ID NO: 557 - DNA, 20 bp, synthetic construct
  misc_feature 1..20: note = Synthetic oligonucleotide
  source 1..20: mol_type = other DNA
ttaaagatttcctcttctta

SEQ ID NO: 558 - DNA, 20 bp, synthetic construct
  misc_feature 1..20: note = Synthetic oligonucleotide
  source 1..20: mol_type = other DNA
aatgatatcatctcatttaa

SEQ ID NO: 559 - DNA, 20 bp, synthetic construct
  misc_feature 1..20: note = Synthetic oligonucleotide
  source 1..20: mol_type = other DNA
gacaaacttttaaatttcac

SEQ ID NO: 560 - DNA, 20 bp, synthetic construct
  misc_feature 1..20: note = Synthetic oligonucleotide
  source 1..20: mol_type = other DNA
accacagcatcctccctcct

SEQ ID NO: 561 - DNA, 20 bp, synthetic construct
  misc_feature 1..20: note = Synthetic oligonucleotide
  source 1..20: mol_type = other DNA
tttgggtctcttagctttct

SEQ ID NO: 562 - DNA, 20 bp, synthetic construct
  misc_feature 1..20: note = Synthetic oligonucleotide
  source 1..20: mol_type = other DNA
gtgaaatcttctaaacaaaa

SEQ ID NO: 563 - DNA, 20 bp, synthetic construct
  misc_feature 1..20: note = Synthetic oligonucleotide
  source 1..20: mol_type = other DNA
aagatcaaatttattagata

SEQ ID NO: 564 - DNA, 20 bp, synthetic construct
  misc_feature 1..20: note = Synthetic oligonucleotide
  source 1..20: mol_type = other DNA
cttccaataaatccatggaa

SEQ ID NO: 565 - DNA, 20 bp, synthetic construct
  misc_feature 1..20: note = Synthetic oligonucleotide
  source 1..20: mol_type = other DNA
acaaatgggtccattacaac

SEQ ID NO: 566 - DNA, 20 bp, synthetic construct
  misc_feature 1..20: note = Synthetic oligonucleotide
  source 1..20: mol_type = other DNA
atggtggtatggttggaaat

SEQ ID NO: 567 - DNA, 20 bp, synthetic construct
  misc_feature 1..20: note = Synthetic oligonucleotide
  source 1..20: mol_type = other DNA
tcagcatattctaacatggt

SEQ ID NO: 568 - DNA, 20 bp, synthetic construct
  misc_feature 1..20: note = Synthetic oligonucleotide
  source 1..20: mol_type = other DNA
cataatatccatccatccct

SEQ ID NO: 569 - DNA, 20 bp, synthetic construct
  misc_feature 1..20: note = Synthetic oligonucleotide
  source 1..20: mol_type = other DNA
ggtttggtcacactatcata

SEQ ID NO: 570 - DNA, 20 bp, synthetic construct
  misc_feature 1..20: note = Synthetic oligonucleotide
  source 1..20: mol_type = other DNA
acgaatagctatttaagcac

SEQ ID NO: 571 - DNA, 20 bp, synthetic construct
  misc_feature 1..20: note = Synthetic oligonucleotide
  source 1..20: mol_type = other DNA
ttttggtcaattcaggcttc

SEQ ID NO: 572 - DNA, 20 bp, synthetic construct
  misc_feature 1..20: note = Synthetic oligonucleotide
  source 1..20: mol_type = other DNA
ccactgggtaaaattactat

SEQ ID NO: 573 - DNA, 20 bp, synthetic construct
  misc_feature 1..20: note = Synthetic oligonucleotide
  source 1..20: mol_type = other DNA
tataatggaaccaattacat

SEQ ID NO: 574 - DNA, 20 bp, synthetic construct
  misc_feature 1..20: note = Synthetic oligonucleotide
  source 1..20: mol_type = other DNA
tttatattttcttagaaaac

SEQ ID NO: 575 - DNA, 20 bp, synthetic construct
  misc_feature 1..20: note = Synthetic oligonucleotide
  source 1..20: mol_type = other DNA
tttacagtactaataaaaaa

SEQ ID NO: 576 - DNA, 20 bp, synthetic construct
  misc_feature 1..20: note = Synthetic oligonucleotide
  source 1..20: mol_type = other DNA
tgcttgtgaaacacaaagta

SEQ ID NO: 577 - DNA, 20 bp, synthetic construct
  misc_feature 1..20: note = Synthetic oligonucleotide
  source 1..20: mol_type = other DNA
caacaattaaatacaaaaac

SEQ ID NO: 578 - DNA, 20 bp, synthetic construct
  misc_feature 1..20: note = Synthetic oligonucleotide
  source 1..20: mol_type = other DNA
ttaattaacttccattccat

SEQ ID NO: 579 - DNA, 20 bp, synthetic construct
  misc_feature 1..20: note = Synthetic oligonucleotide
  source 1..20: mol_type = other DNA
tgttagtcaattttttatta

SEQ ID NO: 580 - DNA, 20 bp, synthetic construct
  misc_feature 1..20: note = Synthetic oligonucleotide
  source 1..20: mol_type = other DNA
ttcactttctcatctttctt

SEQ ID NO: 581 - DNA, 20 bp, synthetic construct
  misc_feature 1..20: note = Synthetic oligonucleotide
  source 1..20: mol_type = other DNA
acttaacaacttaaaactat

SEQ ID NO: 582 - DNA, 20 bp, synthetic construct
  misc_feature 1..20: note = Synthetic oligonucleotide
  source 1..20: mol_type = other DNA
cactaaaactaaaatagtat

SEQ ID NO: 583 - DNA, 20 bp, synthetic construct
  misc_feature 1..20: note = Synthetic oligonucleotide
  source 1..20: mol_type = other DNA
cttaaataaaacatacaact

SEQ ID NO: 584 - DNA, 20 bp, synthetic construct
  misc_feature 1..20: note = Synthetic oligonucleotide
  source 1..20: mol_type = other DNA
gccatattttaataattgtt

SEQ ID NO: 585 - DNA, 20 bp, synthetic construct
  misc_feature 1..20: note = Synthetic oligonucleotide
  source 1..20: mol_type = other DNA
gtatgtttctcctatgccaa

SEQ ID NO: 586 - DNA, 20 bp, synthetic construct
  misc_feature 1..20: note = Synthetic oligonucleotide
  source 1..20: mol_type = other DNA
tttttactttcaacctgtct

SEQ ID NO: 587 - DNA, 20 bp, synthetic construct
  misc_feature 1..20: note = Synthetic oligonucleotide
  source 1..20: mol_type = other DNA
agagatttcacaactttctt

SEQ ID NO: 588 - DNA, 20 bp, synthetic construct
  misc_feature 1..20: note = Synthetic oligonucleotide
  source 1..20: mol_type = other DNA
tacttttaaaatacaactaa

SEQ ID NO: 589 - DNA, 20 bp, synthetic construct
  misc_feature 1..20: note = Synthetic oligonucleotide
  source 1..20: mol_type = other DNA
gggttactctaaacagataa

SEQ ID NO: 590 - DNA, 20 bp, synthetic construct
  misc_feature 1..20: note = Synthetic oligonucleotide
  source 1..20: mol_type = other DNA
atacatctctcctcatattc

SEQ ID NO: 591 - DNA, 20 bp, synthetic construct
  misc_feature 1..20: note = Synthetic oligonucleotide
  source 1..20: mol_type = other DNA
ggtttttcttccatttgttc

SEQ ID NO: 592 - DNA, 20 bp, synthetic construct
  misc_feature 1..20: note = Synthetic oligonucleotide
  source 1..20: mol_type = other DNA
ctcatgctttttatttgcta

SEQ ID NO: 593 - DNA, 20 bp, synthetic construct
  misc_feature 1..20: note = Synthetic oligonucleotide
  source 1..20: mol_type = other DNA
ctcaaagcttttaaatgcta

SEQ ID NO: 594 - DNA, 20 bp, synthetic construct
  misc_feature 1..20: note = Synthetic oligonucleotide
  source 1..20: mol_type = other DNA
ttctgatccattcaaactta

SEQ ID NO: 595 - DNA, 20 bp, synthetic construct
  misc_feature 1..20: note = Synthetic oligonucleotide
  source 1..20: mol_type = other DNA
ccaagcatttttaacttaca

SEQ ID NO: 596 - DNA, 20 bp, synthetic construct
  misc_feature 1..20: note = Synthetic oligonucleotide
  source 1..20: mol_type = other DNA
gttttccattttcctaccat

SEQ ID NO: 597 - DNA, 20 bp, synthetic construct
  misc_feature 1..20: note = Synthetic oligonucleotide
  source 1..20: mol_type = other DNA
tggatcatcataacactggc

SEQ ID NO: 598 - DNA, 20 bp, synthetic construct
  misc_feature 1..20: note = Synthetic oligonucleotide
  source 1..20: mol_type = other DNA
acaagagaaataattatttt

SEQ ID NO: 599 - DNA, 20 bp, synthetic construct
  misc_feature 1..20: note = Synthetic oligonucleotide
  source 1..20: mol_type = other DNA
ctttctattactcttaggat

SEQ ID NO: 600 - DNA, 20 bp, synthetic construct
  misc_feature 1..20: note = Synthetic oligonucleotide
  source 1..20: mol_type = other DNA
acaaacataaccattatata

SEQ ID NO: 601 - DNA, 20 bp, synthetic construct
  misc_feature 1..20: note = Synthetic oligonucleotide
  source 1..20: mol_type = other DNA
ttttctcactcctaatgttt

SEQ ID NO: 602 - DNA, 20 bp, synthetic construct
  misc_feature 1..20: note = Synthetic oligonucleotide
  source 1..20: mol_type = other DNA
ttaaaaagattaaatgcaaa

SEQ ID NO: 603 - DNA, 20 bp, synthetic construct
  misc_feature 1..20: note = Synthetic oligonucleotide
  source 1..20: mol_type = other DNA
gtacatatcttaaagatgac

SEQ ID NO: 604 - DNA, 20 bp, synthetic construct
  misc_feature 1..20: note = Synthetic oligonucleotide
  source 1..20: mol_type = other DNA
tattaaatcatcttaaatta

SEQ ID NO: 605 - DNA, 20 bp, synthetic construct
  misc_feature 1..20: note = Synthetic oligonucleotide
  source 1..20: mol_type = other DNA
tatctagtttttatttttaa

SEQ ID NO: 606 - DNA, 20 bp, synthetic construct
  misc_feature 1..20: note = Synthetic oligonucleotide
  source 1..20: mol_type = other DNA
actttgctaaaatatgctaa

SEQ ID NO: 607 - DNA, 20 bp, synthetic construct
  misc_feature 1..20: note = Synthetic oligonucleotide
  source 1..20: mol_type = other DNA
gcaagttacttaacttgcta

SEQ ID NO: 608 - DNA, 20 bp, synthetic construct
  misc_feature 1..20: note = Synthetic oligonucleotide
  source 1..20: mol_type = other DNA
aagatcataataacatgttc

SEQ ID NO: 609 - DNA, 20 bp, synthetic construct
  misc_feature 1..20: note = Synthetic oligonucleotide
  source 1..20: mol_type = other DNA
atttaggcaaattttggcca

SEQ ID NO: 610 - DNA, 20 bp, synthetic construct
  misc_feature 1..20: note = Synthetic oligonucleotide
  source 1..20: mol_type = other DNA
cccagatctcatcttgagtt

SEQ ID NO: 611 - DNA, 20 bp, synthetic construct
  misc_feature 1..20: note = Synthetic oligonucleotide
  source 1..20: mol_type = other DNA
acatttttaatttatatttc

SEQ ID NO: 612 - DNA, 20 bp, synthetic construct
  misc_feature 1..20: note = Synthetic oligonucleotide
  source 1..20: mol_type = other DNA
ctttcattctccttttctct

SEQ ID NO: 613 - DNA, 20 bp, synthetic construct
  misc_feature 1..20: note = Synthetic oligonucleotide
  source 1..20: mol_type = other DNA
ctaaactcccaaataacctt

SEQ ID NO: 614 - DNA, 20 bp, synthetic construct
  misc_feature 1..20: note = Synthetic oligonucleotide
  source 1..20: mol_type = other DNA
gtacaccctattacctgttc

SEQ ID NO: 615 - DNA, 20 bp, synthetic construct
  misc_feature 1..20: note = Synthetic oligonucleotide
  source 1..20: mol_type = other DNA
aagtctcaaattaaatttta

SEQ ID NO: 616 - DNA, 20 bp, synthetic construct
  misc_feature 1..20: note = Synthetic oligonucleotide
  source 1..20: mol_type = other DNA
tacagatcctacattcctta

SEQ ID NO: 617 - DNA, 20 bp, synthetic construct
  misc_feature 1..20: note = Synthetic oligonucleotide
  source 1..20: mol_type = other DNA
ataggattttctaaatacaa

SEQ ID NO: 618 - DNA, 20 bp, synthetic construct
  misc_feature 1..20: note = Synthetic oligonucleotide
  source 1..20: mol_type = other DNA
cctttcccctaaaattagcc

SEQ ID NO: 619 - DNA, 20 bp, synthetic construct
  misc_feature 1..20: note = Synthetic oligonucleotide
  source 1..20: mol_type = other DNA
ttctttattttatctggcca

SEQ ID NO: 620 - DNA, 20 bp, synthetic construct
  misc_feature 1..20: note = Synthetic oligonucleotide
  source 1..20: mol_type = other DNA
gttcatatttcaaaatctat

SEQ ID NO: 621 - DNA, 20 bp, synthetic construct
  misc_feature 1..20: note = Synthetic oligonucleotide
  source 1..20: mol_type = other DNA
cctatttcccttaactgcat

SEQ ID NO: 622 - DNA, 20 bp, synthetic construct
  misc_feature 1..20: note = Synthetic oligonucleotide
  source 1..20: mol_type = other DNA
cttcttccaacatataccaa

SEQ ID NO: 623 - DNA, 20 bp, synthetic construct
  misc_feature 1..20: note = Synthetic oligonucleotide
  source 1..20: mol_type = other DNA
tcttgatacacatccatcaa

SEQ ID NO: 624 - DNA, 20 bp, synthetic construct
  misc_feature 1..20: note = Synthetic oligonucleotide
  source 1..20: mol_type = other DNA
ctgttatttataccttccta

SEQ ID NO: 625 - DNA, 20 bp, synthetic construct
  misc_feature 1..20: note = Synthetic oligonucleotide
  source 1..20: mol_type = other DNA
atgataaatttaaataatat

SEQ ID NO: 626 - DNA, 20 bp, synthetic construct
  misc_feature 1..20: note = Synthetic oligonucleotide
  source 1..20: mol_type = other DNA
ttcttgataacatcaattaa

SEQ ID NO: 627 - DNA, 20 bp, synthetic construct
  misc_feature 1..20: note = Synthetic oligonucleotide
  source 1..20: mol_type = other DNA
ggccatatggataatacacc

SEQ ID NO: 628 - DNA, 20 bp, synthetic construct
  misc_feature 1..20: note = Synthetic oligonucleotide
  source 1..20: mol_type = other DNA
ttgttattaaatatattcta

SEQ ID NO: 629 - DNA, 20 bp, synthetic construct
  misc_feature 1..20: note = Synthetic oligonucleotide
  source 1..20: mol_type = other DNA
ttggcaatagcgaatcagtg

SEQ ID NO: 630 - DNA, 20 bp, synthetic construct
  misc_feature 1..20: note = Synthetic oligonucleotide
  source 1..20: mol_type = other DNA
acttgagattttaaatatta

SEQ ID NO: 631 - DNA, 20 bp, synthetic construct
  misc_feature 1..20: note = Synthetic oligonucleotide
  source 1..20: mol_type = other DNA
atcatttttttaaaatcctc

SEQ ID NO: 632 - DNA, 20 bp, synthetic construct
  misc_feature 1..20: note = Synthetic oligonucleotide
  source 1..20: mol_type = other DNA
attatttatcttaatgcttc

SEQ ID NO: 633 - DNA, 20 bp, synthetic construct
  misc_feature 1..20: note = Synthetic oligonucleotide
  source 1..20: mol_type = other DNA
tgcactttcctttctaagca

SEQ ID NO: 634 - DNA, 20 bp, synthetic construct
  misc_feature 1..20: note = Synthetic oligonucleotide
  source 1..20: mol_type = other DNA
cggtctgttttatattgtca

SEQ ID NO: 635 - DNA, 20 bp, synthetic construct
  misc_feature 1..20: note = Synthetic oligonucleotide
  source 1..20: mol_type = other DNA
agacaaacttttaaatttca

SEQ ID NO: 636 - DNA, 20 bp, synthetic construct
  misc_feature 1..20: note = Synthetic oligonucleotide
  source 1..20: mol_type = other DNA
atcttatctcttaatgctac

SEQ ID NO: 637 - DNA, 20 bp, synthetic construct
  misc_feature 1..20: note = Synthetic oligonucleotide
  source 1..20: mol_type = other DNA
gctctatcctcattaaagaa

SEQ ID NO: 638 - DNA, 20 bp, synthetic construct
  misc_feature 1..20: note = Synthetic oligonucleotide
  source 1..20: mol_type = other DNA
tgtttgggtctcttagcttt

SEQ ID NO: 639 - DNA, 20 bp, synthetic construct
  misc_feature 1..20: note = Synthetic oligonucleotide
  source 1..20: mol_type = other DNA
tgtgaaatcttctaaacaaa

SEQ ID NO: 640 - DNA, 20 bp, synthetic construct
  misc_feature 1..20: note = Synthetic oligonucleotide
  source 1..20: mol_type = other DNA
atctgctgaaattcagcttc

SEQ ID NO: 641 - DNA, 20 bp, synthetic construct
  misc_feature 1..20: note = Synthetic oligonucleotide
  source 1..20: mol_type = other DNA
ggatcttccaataaatccat

SEQ ID NO: 642 - DNA, 20 bp, synthetic construct
  misc_feature 1..20: note = Synthetic oligonucleotide
  source 1..20: mol_type = other DNA
ggatagtgctccatagccat

SEQ ID NO: 643 - DNA, 20 bp, synthetic construct
  misc_feature 1..20: note = Synthetic oligonucleotide
  source 1..20: mol_type = other DNA
acatatttttctacactgct

SEQ ID NO: 644 - DNA, 20 bp, synthetic construct
  misc_feature 1..20: note = Synthetic oligonucleotide
  source 1..20: mol_type = other DNA
ttgtcagcatattctaacat

SEQ ID NO: 645 - DNA, 20 bp, synthetic construct
  misc_feature 1..20: note = Synthetic oligonucleotide
  source 1..20: mol_type = other DNA
acataatatccatccatccc

SEQ ID NO: 646 - DNA, 20 bp, synthetic construct
  misc_feature 1..20: note = Synthetic oligonucleotide
  source 1..20: mol_type = other DNA
gtctttttcaaatttttctt

SEQ ID NO: 647 - DNA, 20 bp, synthetic construct
  misc_feature 1..20: note = Synthetic oligonucleotide
  source 1..20: mol_type = other DNA
agacaccttaaaaatacgaa

SEQ ID NO: 648 - DNA, 20 bp, synthetic construct
  misc_feature 1..20: note = Synthetic oligonucleotide
  source 1..20: mol_type = other DNA
ttttttggtcaattcaggct

SEQ ID NO: 649 - DNA, 20 bp, synthetic construct
  misc_feature 1..20: note = Synthetic oligonucleotide
  source 1..20: mol_type = other DNA
gtttgctcaaacatgcacca

SEQ ID NO: 650 - DNA, 20 bp, synthetic construct
  misc_feature 1..20: note = Synthetic oligonucleotide
  source 1..20: mol_type = other DNA
ttcaaactataatggaacca

SEQ ID NO: 651 - DNA, 20 bp, synthetic construct
  misc_feature 1..20: note = Synthetic oligonucleotide
  source 1..20: mol_type = other DNA
gtatttatattttcttagaa

SEQ ID NO: 652 - DNA, 20 bp, synthetic construct
  misc_feature 1..20: note = Synthetic oligonucleotide
  source 1..20: mol_type = other DNA
gtttacagtactaataaaaa

SEQ ID NO: 653 - DNA, 20 bp, synthetic construct
  misc_feature 1..20: note = Synthetic oligonucleotide
  source 1..20: mol_type = other DNA
aagaatctacatttattgtt

SEQ ID NO: 654 - DNA, 20 bp, synthetic construct
  misc_feature 1..20: note = Synthetic oligonucleotide
  source 1..20: mol_type = other DNA
acaacaattaaatacaaaaa

SEQ ID NO: 655 - DNA, 20 bp, synthetic construct
  misc_feature 1..20: note = Synthetic oligonucleotide
  source 1..20: mol_type = other DNA
cttaattaacttccattcca

SEQ ID NO: 656 - DNA, 20 bp, synthetic construct
  misc_feature 1..20: note = Synthetic oligonucleotide
  source 1..20: mol_type = other DNA
ggcattattgtaactaccac

SEQ ID NO: 657 - DNA, 20 bp, synthetic construct
  misc_feature 1..20: note = Synthetic oligonucleotide
  source 1..20: mol_type = other DNA
atcctcctaaaatcttttcc

SEQ ID NO: 658 - DNA, 20 bp, synthetic construct
  misc_feature 1..20: note = Synthetic oligonucleotide
  source 1..20: mol_type = other DNA
gcaaaagacttaacaactta

SEQ ID NO: 659 - DNA, 20 bp, synthetic construct
  misc_feature 1..20: note = Synthetic oligonucleotide
  source 1..20: mol_type = other DNA
aacattgtcactaaaactaa

SEQ ID NO: 660 - DNA, 20 bp, synthetic construct
  misc_feature 1..20: note = Synthetic oligonucleotide
  source 1..20: mol_type = other DNA
atattgatattatctagaaa

SEQ ID NO: 661 - DNA, 20 bp, synthetic construct
  misc_feature 1..20: note = Synthetic oligonucleotide
  source 1..20: mol_type = other DNA
agccatattttaataattgt

SEQ ID NO: 662 - DNA, 20 bp, synthetic construct
  misc_feature 1..20: note = Synthetic oligonucleotide
  source 1..20: mol_type = other DNA
ttttactcaacctaatgtcc

SEQ ID NO: 663 - DNA, 20 bp, synthetic construct
  misc_feature 1..20: note = Synthetic oligonucleotide
  source 1..20: mol_type = other DNA
actgatttttttactttcaa

SEQ ID NO: 664 - DNA, 20 bp, synthetic construct
  misc_feature 1..20: note = Synthetic oligonucleotide
  source 1..20: mol_type = other DNA
taaggattaaactaaaatca

SEQ ID NO: 665 - DNA, 20 bp, synthetic construct
  misc_feature 1..20: note = Synthetic oligonucleotide
  source 1..20: mol_type = other DNA
gcttacttttaaaatacaac

SEQ ID NO: 666 - DNA, 20 bp, synthetic construct
  misc_feature 1..20: note = Synthetic oligonucleotide
  source 1..20: mol_type = other DNA
ttattataattaactgggtt

SEQ ID NO: 667 - DNA, 20 bp, synthetic construct
  misc_feature 1..20: note = Synthetic oligonucleotide
  source 1..20: mol_type = other DNA
tggatccctttctataccta

SEQ ID NO: 668 - DNA, 20 bp, synthetic construct
  misc_feature 1..20: note = Synthetic oligonucleotide
  source 1..20: mol_type = other DNA
agtctgtttctcatttccca

SEQ ID NO: 669 - DNA, 20 bp, synthetic construct
  misc_feature 1..20: note = Synthetic oligonucleotide
  source 1..20: mol_type = other DNA
cttttcaaaaaatcaatcta

SEQ ID NO: 670 - DNA, 20 bp, synthetic construct
  misc_feature 1..20: note = Synthetic oligonucleotide
  source 1..20: mol_type = other DNA
acttcaataaaacataggaa

SEQ ID NO: 671 - DNA, 20 bp, synthetic construct
  misc_feature 1..20: note = Synthetic oligonucleotide
  source 1..20: mol_type = other DNA
ctccatctcatcattcagat

SEQ ID NO: 672 - DNA, 20 bp, synthetic construct
  misc_feature 1..20: note = Synthetic oligonucleotide
  source 1..20: mol_type = other DNA
ctagtggtaataaatataca

SEQ ID NO: 673 - DNA, 20 bp, synthetic construct
  misc_feature 1..20: note = Synthetic oligonucleotide
  source 1..20: mol_type = other DNA
tatgttttccattttcctac

SEQ ID NO: 674 - DNA, 20 bp, synthetic construct
  misc_feature 1..20: note = Synthetic oligonucleotide
  source 1..20: mol_type = other DNA
gcctggatcatcataacact

SEQ ID NO: 675 - DNA, 20 bp, synthetic construct
  misc_feature 1..20: note = Synthetic oligonucleotide
  source 1..20: mol_type = other DNA
atatatttcaacattaacaa

SEQ ID NO: 676 - DNA, 20 bp, synthetic construct
  misc_feature 1..20: note = Synthetic oligonucleotide
  source 1..20: mol_type = other DNA
gtagctttctattactctta

SEQ ID NO: 677 - DNA, 20 bp, synthetic construct
  misc_feature 1..20: note = Synthetic oligonucleotide
  source 1..20: mol_type = other DNA
tgctcaacaaacataaccat

SEQ ID NO: 678 - DNA, 20 bp, synthetic construct
  misc_feature 1..20: note = Synthetic oligonucleotide
  source 1..20: mol_type = other DNA
tcatatcttttctcactcct

SEQ ID NO: 679 - DNA, 20 bp, synthetic construct
  misc_feature 1..20: note = Synthetic oligonucleotide
  source 1..20: mol_type = other DNA
gccaagccatcaactatttt

SEQ ID NO: 680 - DNA, 20 bp, synthetic construct
  misc_feature 1..20: note = Synthetic oligonucleotide
  source 1..20: mol_type = other DNA
agtggttaatttacaagtac

SEQ ID NO: 681 - DNA, 20 bp, synthetic construct
  misc_feature 1..20: note = Synthetic oligonucleotide
  source 1..20: mol_type = other DNA
tatgtattaaatcatcttaa

SEQ ID NO: 682 - DNA, 20 bp, synthetic construct
  misc_feature 1..20: note = Synthetic oligonucleotide
  source 1..20: mol_type = other DNA
atttattccctcttatgata

SEQ ID NO: 683 - DNA, 20 bp, synthetic construct
  misc_feature 1..20: note = Synthetic oligonucleotide
  source 1..20: mol_type = other DNA
gtttgtaaccactttgctaa

SEQ ID NO: 684 - DNA, 20 bp, synthetic construct
  misc_feature 1..20: note = Synthetic oligonucleotide
  source 1..20: mol_type = other DNA
aagcaatcatatcatgatta

SEQ ID NO: 685 - DNA, 20 bp, synthetic construct
  misc_feature 1..20: note = Synthetic oligonucleotide
  source 1..20: mol_type = other DNA
ctatgatatctaattatcta

SEQ ID NO: 686 - DNA, 20 bp, synthetic construct
  misc_feature 1..20: note = Synthetic oligonucleotide
  source 1..20: mol_type = other DNA
tagttttattcaattagaaa

SEQ ID NO: 687 - DNA, 20 bp, synthetic construct
  misc_feature 1..20: note = Synthetic oligonucleotide
  source 1..20: mol_type = other DNA
acccagatctcatcttgagt

SEQ ID NO: 688 - DNA, 20 bp, synthetic construct
  misc_feature 1..20: note = Synthetic oligonucleotide
  source 1..20: mol_type = other DNA
attcacatttttaatttata

SEQ ID NO: 689 - DNA, 20 bp, synthetic construct
  misc_feature 1..20: note = Synthetic oligonucleotide
  source 1..20: mol_type = other DNA
agtaatgtcttatttagctc

SEQ ID NO: 690 - DNA, 20 bp, synthetic construct
  misc_feature 1..20: note = Synthetic oligonucleotide
  source 1..20: mol_type = other DNA
aaatacttctaaactcccaa

SEQ ID NO: 691 - DNA, 20 bp, synthetic construct
  misc_feature 1..20: note = Synthetic oligonucleotide
  source 1..20: mol_type = other DNA
ataatctcttcatcaactta

SEQ ID NO: 692 - DNA, 20 bp, synthetic construct
  misc_feature 1..20: note = Synthetic oligonucleotide
  source 1..20: mol_type = other DNA
gtgatcttctaattagataa

SEQ ID NO: 693 - DNA, 20 bp, synthetic construct
  misc_feature 1..20: note = Synthetic oligonucleotide
  source 1..20: mol_type = other DNA
tactattccataattcacct

SEQ ID NO: 694 - DNA, 20 bp, synthetic construct
  misc_feature 1..20: note = Synthetic oligonucleotide
  source 1..20: mol_type = other DNA
gcaatcttatttattagttc

SEQ ID NO: 695 - DNA, 20 bp, synthetic construct
  misc_feature 1..20: note = Synthetic oligonucleotide
  source 1..20: mol_type = other DNA
gcctttcccctaaaattagc

SEQ ID NO: 696 - DNA, 20 bp, synthetic construct
  misc_feature 1..20: note = Synthetic oligonucleotide
  source 1..20: mol_type = other DNA
tttgtttatcttaaaattct

SEQ ID NO: 697 - DNA, 20 bp, synthetic construct
  misc_feature 1..20: note = Synthetic oligonucleotide
  source 1..20: mol_type = other DNA
ttacatttttataatagttc

SEQ ID NO: 698 - DNA, 20 bp, synthetic construct
  misc_feature 1..20: note = Synthetic oligonucleotide
  source 1..20: mol_type = other DNA
accaaagtatttaatttatt

SEQ ID NO: 699 - DNA, 20 bp, synthetic construct
  misc_feature 1..20: note = Synthetic oligonucleotide
  source 1..20: mol_type = other DNA
tcttcttccaacatatacca

SEQ ID NO: 700 - DNA, 20 bp, synthetic construct
  misc_feature 1..20: note = Synthetic oligonucleotide
  source 1..20: mol_type = other DNA
tggattaaaaaaacagacaa

SEQ ID NO: 701 - DNA, 20 bp, synthetic construct
  misc_feature 1..20: note = Synthetic oligonucleotide
  source 1..20: mol_type = other DNA
attaaagtaattctttgccc

SEQ ID NO: 702 - DNA, 20 bp, synthetic construct
  misc_feature 1..20: note = Synthetic oligonucleotide
  source 1..20: mol_type = other DNA
catgataaatttaaataata

SEQ ID NO: 703 - DNA, 20 bp, synthetic construct
  misc_feature 1..20: note = Synthetic oligonucleotide
  source 1..20: mol_type = other DNA
attctgatttataaaaccct

SEQ ID NO: 704 - DNA, 20 bp, synthetic construct
  misc_feature 1..20: note = Synthetic oligonucleotide
  source 1..20: mol_type = other DNA
aggccatatggataatacac

SEQ ID NO: 705 - DNA, 20 bp, synthetic construct
  misc_feature 1..20: note = Synthetic oligonucleotide
  source 1..20: mol_type = other DNA
tgacatgaaaacatatacca

SEQ ID NO: 706 - DNA, 20 bp, synthetic construct
  misc_feature 1..20: note = Synthetic oligonucleotide
  source 1..20: mol_type = other DNA
gttggcaatagcgaatcagt

SEQ ID NO: 707 - DNA, 20 bp, synthetic construct
  misc_feature 1..20: note = Synthetic oligonucleotide
  source 1..20: mol_type = other DNA
attcatattttattttgcat

SEQ ID NO: 708 - DNA, 20 bp, synthetic construct
  misc_feature 1..20: note = Synthetic oligonucleotide
  source 1..20: mol_type = other DNA
tatcatttttttaaaatcct

SEQ ID NO: 709 - DNA, 20 bp, synthetic construct
  misc_feature 1..20: note = Synthetic oligonucleotide
  source 1..20: mol_type = other DNA
atgctatcataaaaacaata

SEQ ID NO: 710 - DNA, 20 bp, synthetic construct
  misc_feature 1..20: note = Synthetic oligonucleotide
  source 1..20: mol_type = other DNA
tagacaatttcacccaacaa

SEQ ID NO: 711 - DNA, 20 bp, synthetic construct
  misc_feature 1..20: note = Synthetic oligonucleotide
  source 1..20: mol_type = other DNA
tatccattttctttgagtta

SEQ ID NO: 712 - DNA, 20 bp, synthetic construct
  misc_feature 1..20: note = Synthetic oligonucleotide
  source 1..20: mol_type = other DNA
tctttagttcccatattcaa

SEQ ID NO: 713 - DNA, 20 bp, synthetic construct
  misc_feature 1..20: note = Synthetic oligonucleotide
  source 1..20: mol_type = other DNA
aatcttatctcttaatgcta

SEQ ID NO: 714 - DNA, 20 bp, synthetic construct
  misc_feature 1..20: note = Synthetic oligonucleotide
  source 1..20: mol_type = other DNA
atgtgctctatcctcattaa

SEQ ID NO: 715 - DNA, 20 bp, synthetic construct
  misc_feature 1..20: note = Synthetic oligonucleotide
  source 1..20: mol_type = other DNA
ctgtttgggtctcttagctt

SEQ ID NO: 716 - DNA, 20 bp, synthetic construct
  misc_feature 1..20: note = Synthetic oligonucleotide
  source 1..20: mol_type = other DNA
atgtgaaatcttctaaacaa

SEQ ID NO: 717 - DNA, 20 bp, synthetic construct
  misc_feature 1..20: note = Synthetic oligonucleotide
  source 1..20: mol_type = other DNA
agcatctgctgaaattcagc

SEQ ID NO: 718 - DNA, 20 bp, synthetic construct
  misc_feature 1..20: note = Synthetic oligonucleotide
  source 1..20: mol_type = other DNA
aggatcttccaataaatcca

SEQ ID NO: 719 - DNA, 20 bp, synthetic construct
  misc_feature 1..20: note = Synthetic oligonucleotide
  source 1..20: mol_type = other DNA
gggatagtgctccatagcca

SEQ ID NO: 720 - DNA, 20 bp, synthetic construct
  misc_feature 1..20: note = Synthetic oligonucleotide
  source 1..20: mol_type = other DNA
gacatatttttctacactgc

SEQ ID NO: 721 - DNA, 20 bp, synthetic construct
  misc_feature 1..20: note = Synthetic oligonucleotide
  source 1..20: mol_type = other DNA
accttgtcagcatattctaa

SEQ ID NO: 722 - DNA, 20 bp, synthetic construct
  misc_feature 1..20: note = Synthetic oligonucleotide
  source 1..20: mol_type = other DNA
tacataatatccatccatcc

SEQ ID NO: 723 - DNA, 20 bp, synthetic construct
  misc_feature 1..20: note = Synthetic oligonucleotide
  source 1..20: mol_type = other DNA
atttgtctttttcaaatttt

SEQ ID NO: 724 - DNA, 20 bp, synthetic construct
  misc_feature 1..20: note = Synthetic oligonucleotide
  source 1..20: mol_type = other DNA
ggcacattaaattttttctg

SEQ ID NO: 725 - DNA, 20 bp, synthetic construct
  misc_feature 1..20: note = Synthetic oligonucleotide
  source 1..20: mol_type = other DNA
atcaactttataaagtggtg

SEQ ID NO: 726 - DNA, 20 bp, synthetic construct
  misc_feature 1..20: note = Synthetic oligonucleotide
  source 1..20: mol_type = other DNA
tttgtttgctcaaacatgca

SEQ ID NO: 727 - DNA, 20 bp, synthetic construct
  misc_feature 1..20: note = Synthetic oligonucleotide
  source 1..20: mol_type = other DNA
acagtatttatattttctta

SEQ ID NO: 728 - DNA, 20 bp, synthetic construct
  misc_feature 1..20: note = Synthetic oligonucleotide
  source 1..20: mol_type = other DNA
gtgcaagtttacagtactaa

SEQ ID NO: 729 - DNA, 20 bp, synthetic construct
  misc_feature 1..20: note = Synthetic oligonucleotide
  source 1..20: mol_type = other DNA
aaagaatctacatttattgt

SEQ ID NO: 730 - DNA, 20 bp, synthetic construct
  misc_feature 1..20: note = Synthetic oligonucleotide
  source 1..20: mol_type = other DNA
agacaacaattaaatacaaa

SEQ ID NO: 731 - DNA, 20 bp, synthetic construct
  misc_feature 1..20: note = Synthetic oligonucleotide
  source 1..20: mol_type = other DNA
tcttaattaacttccattcc

SEQ ID NO: 732 - DNA, 20 bp, synthetic construct
  misc_feature 1..20: note = Synthetic oligonucleotide
  source 1..20: mol_type = other DNA
tttttttaattctccttcaa

SEQ ID NO: 733 - DNA, 20 bp, synthetic construct
  misc_feature 1..20: note = Synthetic oligonucleotide
  source 1..20: mol_type = other DNA
tcacatcctcctaaaatctt

SEQ ID NO: 734 - DNA, 20 bp, synthetic construct
  misc_feature 1..20: note = Synthetic oligonucleotide
  source 1..20: mol_type = other DNA
acacaatcacataattgtat

SEQ ID NO: 735 - DNA, 20 bp, synthetic construct
  misc_feature 1..20: note = Synthetic oligonucleotide
  source 1..20: mol_type = other DNA
attatattaatcaaagtctt

SEQ ID NO: 736 - DNA, 20 bp, synthetic construct
  misc_feature 1..20: note = Synthetic oligonucleotide
  source 1..20: mol_type = other DNA
gagtttttattttctagcaa

SEQ ID NO: 737 - DNA, 20 bp, synthetic construct
  misc_feature 1..20: note = Synthetic oligonucleotide
  source 1..20: mol_type = other DNA
gagccatattttaataattg

SEQ ID NO: 738 - DNA, 20 bp, synthetic construct
  misc_feature 1..20: note = Synthetic oligonucleotide
  source 1..20: mol_type = other DNA
tggcttattttactcaacct

SEQ ID NO: 739 - DNA, 20 bp, synthetic construct
  misc_feature 1..20: note = Synthetic oligonucleotide
  source 1..20: mol_type = other DNA
ttttgatattcatatagcca

SEQ ID NO: 740 - DNA, 20 bp, synthetic construct
  misc_feature 1..20: note = Synthetic oligonucleotide
  source 1..20: mol_type = other DNA
cttatattcattaaggatta

SEQ ID NO: 741 - DNA, 20 bp, synthetic construct
  misc_feature 1..20: note = Synthetic oligonucleotide
  source 1..20: mol_type = other DNA
ggcttacttttaaaatacaa

SEQ ID NO: 742 - DNA, 20 bp, synthetic construct
  misc_feature 1..20: note = Synthetic oligonucleotide
  source 1..20: mol_type = other DNA
gcagattcaatattttatta

SEQ ID NO: 743 - DNA, 20 bp, synthetic construct
  misc_feature 1..20: note = Synthetic oligonucleotide
  source 1..20: mol_type = other DNA
ctgatttcaaatactaaata

SEQ ID NO: 744 - DNA, 20 bp, synthetic construct
  misc_feature 1..20: note = Synthetic oligonucleotide
  source 1..20: mol_type = other DNA
ttttttcacatcaaagatac

SEQ ID NO: 745 - DNA, 20 bp, synthetic construct
  misc_feature 1..20: note = Synthetic oligonucleotide
  source 1..20: mol_type = other DNA
tattttttccatcttttcaa

SEQ ID NO: 746 - DNA, 20 bp, synthetic construct
  misc_feature 1..20: note = Synthetic oligonucleotide
  source 1..20: mol_type = other DNA
actactctatttaatttcaa

SEQ ID NO: 747 - DNA, 20 bp, synthetic construct
  misc_feature 1..20: note = Synthetic oligonucleotide
  source 1..20: mol_type = other DNA
tgggttttcttaactccatc

SEQ ID NO: 748 - DNA, 20 bp, synthetic construct
  misc_feature 1..20: note = Synthetic oligonucleotide
  source 1..20: mol_type = other DNA
aagtttaaaataaaaactta

SEQ ID NO: 749 - DNA, 20 bp, synthetic construct
  misc_feature 1..20: note = Synthetic oligonucleotide
  source 1..20: mol_type = other DNA
ctatgttttccattttccta

SEQ ID NO: 750 - DNA, 20 bp, synthetic construct
  misc_feature 1..20: note = Synthetic oligonucleotide
  source 1..20: mol_type = other DNA
ctattaatttctttatgcca

SEQ ID NO: 751 - DNA, 20 bp, synthetic construct
  misc_feature 1..20: note = Synthetic oligonucleotide
  source 1..20: mol_type = other DNA
atagtggtataatttagtta

SEQ ID NO: 752 - DNA, 20 bp, synthetic construct
  misc_feature 1..20: note = Synthetic oligonucleotide
  source 1..20: mol_type = other DNA
tggtagctttctattactct

SEQ ID NO: 753 - DNA, 20 bp, synthetic construct
  misc_feature 1..20: note = Synthetic oligonucleotide
  source 1..20: mol_type = other DNA
acattgctcaacaaacataa

SEQ ID NO: 754 - DNA, 20 bp, synthetic construct
  misc_feature 1..20: note = Synthetic oligonucleotide
  source 1..20: mol_type = other DNA
gtgctcttcatatcttttct

SEQ ID NO: 755 - DNA, 20 bp, synthetic construct
  misc_feature 1..20: note = Synthetic oligonucleotide
  source 1..20: mol_type = other DNA
agcaacctcatatttagatc

SEQ ID NO: 756 - DNA, 20 bp, synthetic construct
  misc_feature 1..20: note = Synthetic oligonucleotide
  source 1..20: mol_type = other DNA
aagctcacattaaaaatcta

SEQ ID NO: 757 - DNA, 20 bp, synthetic construct
  misc_feature 1..20: note = Synthetic oligonucleotide
  source 1..20: mol_type = other DNA
cttttactatatcaatggac

SEQ ID NO: 758 - DNA, 20 bp, synthetic construct
  misc_feature 1..20: note = Synthetic oligonucleotide
  source 1..20: mol_type = other DNA
tatttattccctcttatgat

SEQ ID NO: 759 - DNA, 20 bp, synthetic construct
  misc_feature 1..20: note = Synthetic oligonucleotide
  source 1..20: mol_type = other DNA
attattatacccatttgtca

SEQ ID NO: 760 - DNA, 20 bp, synthetic construct
  misc_feature 1..20: note = Synthetic oligonucleotide
  source 1..20: mol_type = other DNA
atgtctccatataaaagcaa

SEQ ID NO: 761 - DNA, 20 bp, synthetic construct
  misc_feature 1..20: note = Synthetic oligonucleotide
  source 1..20: mol_type = other DNA
ttcatgtaatttaatatttt

SEQ ID NO: 762 - DNA, 20 bp, synthetic construct
  misc_feature 1..20: note = Synthetic oligonucleotide
  source 1..20: mol_type = other DNA
gagaatatcatatctatgaa

SEQ ID NO: 763 - DNA, 20 bp, synthetic construct
  misc_feature 1..20: note = Synthetic oligonucleotide
  source 1..20: mol_type = other DNA
atctaggtttttatatgcct

SEQ ID NO: 764 - DNA, 20 bp, synthetic construct
  misc_feature 1..20: note = Synthetic oligonucleotide
  source 1..20: mol_type = other DNA
atatcaaaccctaattcaca

SEQ ID NO: 765 - DNA, 20 bp, synthetic construct
  misc_feature 1..20: note = Synthetic oligonucleotide
  source 1..20: mol_type = other DNA
tgaactccaaatcttaatta

SEQ ID NO: 766 - DNA, 20 bp, synthetic construct
  misc_feature 1..20: note = Synthetic oligonucleotide
  source 1..20: mol_type = other DNA
tagttattatgcactagtta

SEQ ID NO: 767 - DNA, 20 bp, synthetic construct
  misc_feature 1..20: note = Synthetic oligonucleotide
  source 1..20: mol_type = other DNA
gcaagataatctcttcatca

SEQ ID NO: 768 - DNA, 20 bp, synthetic construct
  misc_feature 1..20: note = Synthetic oligonucleotide
  source 1..20: mol_type = other DNA
ggtgatcttctaattagata

SEQ ID NO: 769 - DNA, 20 bp, synthetic construct
  misc_feature 1..20: note = Synthetic oligonucleotide
  source 1..20: mol_type = other DNA
ttctactattccataattca

SEQ ID NO: 770 - DNA, 20 bp, synthetic construct
  misc_feature 1..20: note = Synthetic oligonucleotide
  source 1..20: mol_type = other DNA
ttctgcaatcttatttatta

SEQ ID NO: 771 - DNA, 20 bp, synthetic construct
  misc_feature 1..20: note = Synthetic oligonucleotide
  source 1..20: mol_type = other DNA
tttttccacatccttgataa

SEQ ID NO: 772 - DNA, 20 bp, synthetic construct
  misc_feature 1..20: note = Synthetic oligonucleotide
  source 1..20: mol_type = other DNA
atatttttcctattcggcct

SEQ ID NO: 773 - DNA, 20 bp, synthetic construct
  misc_feature 1..20: note = Synthetic oligonucleotide
  source 1..20: mol_type = other DNA
ctttagttttccttttataa

SEQ ID NO: 774 - DNA, 20 bp, synthetic construct
  misc_feature 1..20: note = Synthetic oligonucleotide
  source 1..20: mol_type = other DNA
agtgcattatttaatggcat

SEQ ID NO: 775 - DNA, 20 bp, synthetic construct
  misc_feature 1..20: note = Synthetic oligonucleotide
  source 1..20: mol_type = other DNA
ttatatttcttaattcccca

SEQ ID NO: 776 - DNA, 20 bp, synthetic construct
  misc_feature 1..20: note = Synthetic oligonucleotide
  source 1..20: mol_type = other DNA
gtcagtctctatactatgac

SEQ ID NO: 777 - DNA, 20 bp, synthetic construct
  misc_feature 1..20: note = Synthetic oligonucleotide
  source 1..20: mol_type = other DNA
attcaactttcaaacaataa

SEQ ID NO: 778 - DNA, 20 bp, synthetic construct
  misc_feature 1..20: note = Synthetic oligonucleotide
  source 1..20: mol_type = other DNA
cttcattttaaaaacaccct

SEQ ID NO: 779 - DNA, 20 bp, synthetic construct
  misc_feature 1..20: note = Synthetic oligonucleotide
  source 1..20: mol_type = other DNA
tttatcaatttaaaacattt

SEQ ID NO: 780 - DNA, 20 bp, synthetic construct
  misc_feature 1..20: note = Synthetic oligonucleotide
  source 1..20: mol_type = other DNA
taggccatatggataataca

SEQ ID NO: 781 - DNA, 20 bp, synthetic construct
  misc_feature 1..20: note = Synthetic oligonucleotide
  source 1..20: mol_type = other DNA
cagcaaccatctaaatttat

SEQ ID NO: 782 - DNA, 20 bp, synthetic construct
  misc_feature 1..20: note = Synthetic oligonucleotide
  source 1..20: mol_type = other DNA
tggttggcaatagcgaatca

SEQ ID NO: 783 - DNA, 20 bp, synthetic construct
  misc_feature 1..20: note = Synthetic oligonucleotide
  source 1..20: mol_type = other DNA
agcaaaatttctaaattcat

SEQ ID NO: 784 - DNA, 20 bp, synthetic construct
  misc_feature 1..20: note = Synthetic oligonucleotide
  source 1..20: mol_type = other DNA
aacttattttcaaatatcac

SEQ ID NO: 785 - DNA, 20 bp, synthetic construct
  misc_feature 1..20: note = Synthetic oligonucleotide
  source 1..20: mol_type = other DNA
ttatattcctctataacatc

SEQ ID NO: 786 - DNA, 20 bp, synthetic construct
  misc_feature 1..20: note = Synthetic oligonucleotide
  source 1..20: mol_type = other DNA
agtgagtttttaattatcta

SEQ ID NO: 787 - DNA, 20 bp, synthetic construct
  misc_feature 1..20: note = Synthetic oligonucleotide
  source 1..20: mol_type = other DNA
tgtttgacccaatatagcta

SEQ ID NO: 788 - DNA, 20 bp, synthetic construct
  misc_feature 1..20: note = Synthetic oligonucleotide
  source 1..20: mol_type = other DNA
tagcatctccaattttctca

SEQ ID NO: 789 - DNA, 20 bp, synthetic construct
  misc_feature 1..20: note = Synthetic oligonucleotide
  source 1..20: mol_type = other DNA
cagatctcaaatcttatctc

SEQ ID NO: 790 - DNA, 20 bp, synthetic construct
  misc_feature 1..20: note = Synthetic oligonucleotide
  source 1..20: mol_type = other DNA
catgtgctctatcctcatta

SEQ ID NO: 791 - DNA, 20 bp, synthetic construct
  misc_feature 1..20: note = Synthetic oligonucleotide
  source 1..20: mol_type = other DNA
cctgtttgggtctcttagct

SEQ ID NO: 792 - DNA, 20 bp, synthetic construct
  misc_feature 1..20: note = Synthetic oligonucleotide
  source 1..20: mol_type = other DNA
tgaaattgttttcaatgctc

SEQ ID NO: 793 - DNA, 20 bp, synthetic construct
  misc_feature 1..20: note = Synthetic oligonucleotide
  source 1..20: mol_type = other DNA
ttgttgctttttcaactgtt

SEQ ID NO: 794 - DNA, 20 bp, synthetic construct
  misc_feature 1..20: note = Synthetic oligonucleotide
  source 1..20: mol_type = other DNA
taggatcttccaataaatcc

SEQ ID NO: 795 - DNA, 20 bp, synthetic construct
  misc_feature 1..20: note = Synthetic oligonucleotide
  source 1..20: mol_type = other DNA
aggtttccaacagacagtac

SEQ ID NO: 796 - DNA, 20 bp, synthetic construct
  misc_feature 1..20: note = Synthetic oligonucleotide
  source 1..20: mol_type = other DNA
gtaatcactttcatccacga

SEQ ID NO: 797 - DNA, 20 bp, synthetic construct
  misc_feature 1..20: note = Synthetic oligonucleotide
  source 1..20: mol_type = other DNA
tgtaagtgaaaaccttgtca

SEQ ID NO: 798 - DNA, 20 bp, synthetic construct
  misc_feature 1..20: note = Synthetic oligonucleotide
  source 1..20: mol_type = other DNA
catacataatatccatccat

SEQ ID NO: 799 - DNA, 20 bp, synthetic construct
  misc_feature 1..20: note = Synthetic oligonucleotide
  source 1..20: mol_type = other DNA
ctttgtcttccttttctgat

SEQ ID NO: 800 - DNA, 20 bp, synthetic construct
  misc_feature 1..20: note = Synthetic oligonucleotide
  source 1..20: mol_type = other DNA
atggaacatttacaggcaca

SEQ ID NO: 801 - DNA, 20 bp, synthetic construct
  misc_feature 1..20: note = Synthetic oligonucleotide
  source 1..20: mol_type = other DNA
aatcaactttataaagtggt

SEQ ID NO: 802 - DNA, 20 bp, synthetic construct
  misc_feature 1..20: note = Synthetic oligonucleotide
  source 1..20: mol_type = other DNA
ttttgtttgctcaaacatgc

SEQ ID NO: 803 - DNA, 20 bp, synthetic construct
  misc_feature 1..20: note = Synthetic oligonucleotide
  source 1..20: mol_type = other DNA
agcttcaaactataatggaa

SEQ ID NO: 804 - DNA, 20 bp, synthetic construct
  misc_feature 1..20: note = Synthetic oligonucleotide
  source 1..20: mol_type = other DNA
ttacagtatttatattttct

SEQ ID NO: 805 - DNA, 20 bp, synthetic construct
  misc_feature 1..20: note = Synthetic oligonucleotide
  source 1..20: mol_type = other DNA
tgtgcaagtttacagtacta

SEQ ID NO: 806 - DNA, 20 bp, synthetic construct
  misc_feature 1..20: note = Synthetic oligonucleotide
  source 1..20: mol_type = other DNA
tataaagaatctacatttat

SEQ ID NO: 807 - DNA, 20 bp, synthetic construct
  misc_feature 1..20: note = Synthetic oligonucleotide
  source 1..20: mol_type = other DNA
aagacaacaattaaatacaa

SEQ ID NO: 808 - DNA, 20 bp, synthetic construct
  misc_feature 1..20: note = Synthetic oligonucleotide
  source 1..20: mol_type = other DNA
tcttcttaattaacttccat

SEQ ID NO: 809 - DNA, 20 bp, synthetic construct
  misc_feature 1..20: note = Synthetic oligonucleotide
  source 1..20: mol_type = other DNA
ttttttttaattctccttca

SEQ ID NO: 810 - DNA, 20 bp, synthetic construct
  misc_feature 1..20: note = Synthetic oligonucleotide
  source 1..20: mol_type = other DNA
gtcacatcctcctaaaatct

SEQ ID NO: 811 - DNA, 20 bp, synthetic construct
  misc_feature 1..20: note = Synthetic oligonucleotide
  source 1..20: mol_type = other DNA
atacatatcacacaacacaa

SEQ ID NO: 812 - DNA, 20 bp, synthetic construct
  misc_feature 1..20: note = Synthetic oligonucleotide
  source 1..20: mol_type = other DNA
gttagctattatattaatca

SEQ ID NO: 813 - DNA, 20 bp, synthetic construct
  misc_feature 1..20: note = Synthetic oligonucleotide
  source 1..20: mol_type = other DNA
atatcaacaaatacaaacaa

SEQ ID NO: 814 - DNA, 20 bp, synthetic construct
  misc_feature 1..20: note = Synthetic oligonucleotide
  source 1..20: mol_type = other DNA
actgaaattatcattattac

SEQ ID NO: 815 - DNA, 20 bp, synthetic construct
  misc_feature 1..20: note = Synthetic oligonucleotide
  source 1..20: mol_type = other DNA
tttttagattccatacctaa

SEQ ID NO: 816 - DNA, 20 bp, synthetic construct
  misc_feature 1..20: note = Synthetic oligonucleotide
  source 1..20: mol_type = other DNA
tttgtcttaaaatctacttt

SEQ ID NO: 817 - DNA, 20 bp, synthetic construct
  misc_feature 1..20: note = Synthetic oligonucleotide
  source 1..20: mol_type = other DNA
caggcttcttatattcatta

SEQ ID NO: 818 - DNA, 20 bp, synthetic construct
  misc_feature 1..20: note = Synthetic oligonucleotide
  source 1..20: mol_type = other DNA
tggcttacttttaaaataca

SEQ ID NO: 819 - DNA, 20 bp, synthetic construct
  misc_feature 1..20: note = Synthetic oligonucleotide
  source 1..20: mol_type = other DNA
catgcagattcaatatttta

SEQ ID NO: 820 - DNA, 20 bp, synthetic construct
  misc_feature 1..20: note = Synthetic oligonucleotide
  source 1..20: mol_type = other DNA
tgtctgatttcaaatactaa

SEQ ID NO: 821 - DNA, 20 bp, synthetic construct
  misc_feature 1..20: note = Synthetic oligonucleotide
  source 1..20: mol_type = other DNA
tattttttcacatcaaagat

SEQ ID NO: 822 - DNA, 20 bp, synthetic construct
  misc_feature 1..20: note = Synthetic oligonucleotide
  source 1..20: mol_type = other DNA
atacaatcaacatcttgact

SEQ ID NO: 823 - DNA, 20 bp, synthetic construct
  misc_feature 1..20: note = Synthetic oligonucleotide
  source 1..20: mol_type = other DNA
aactactctatttaatttca

SEQ ID NO: 824 - DNA, 20 bp, synthetic construct
  misc_feature 1..20: note = Synthetic oligonucleotide
  source 1..20: mol_type = other DNA
acaaaagttttaaaacaaaa

SEQ ID NO: 825 - DNA, 20 bp, synthetic construct
  misc_feature 1..20: note = Synthetic oligonucleotide
  source 1..20: mol_type = other DNA
acaatagctcctaatagata

SEQ ID NO: 826 - DNA, 20 bp, synthetic construct
  misc_feature 1..20: note = Synthetic oligonucleotide
  source 1..20: mol_type = other DNA
cctatgttttccattttcct

SEQ ID NO: 827 - DNA, 20 bp, synthetic construct
  misc_feature 1..20: note = Synthetic oligonucleotide
  source 1..20: mol_type = other DNA
ttttaatctattaatttctt

SEQ ID NO: 828 - DNA, 20 bp, synthetic construct
  misc_feature 1..20: note = Synthetic oligonucleotide
  source 1..20: mol_type = other DNA
acttactctttatagtggta

SEQ ID NO: 829 - DNA, 20 bp, synthetic construct
  misc_feature 1..20: note = Synthetic oligonucleotide
  source 1..20: mol_type = other DNA
atttaatccattctgcatac

SEQ ID NO: 830 - DNA, 20 bp, synthetic construct
  misc_feature 1..20: note = Synthetic oligonucleotide
  source 1..20: mol_type = other DNA
ccatcaacaaacattgctca

SEQ ID NO: 831 - DNA, 20 bp, synthetic construct
  misc_feature 1..20: note = Synthetic oligonucleotide
  source 1..20: mol_type = other DNA
tcatatttaataaaaagcat

SEQ ID NO: 832 - DNA, 20 bp, synthetic construct
  misc_feature 1..20: note = Synthetic oligonucleotide
  source 1..20: mol_type = other DNA
gccatttctataactcagca

SEQ ID NO: 833 - DNA, 20 bp, synthetic construct
  misc_feature 1..20: note = Synthetic oligonucleotide
  source 1..20: mol_type = other DNA
gccaagctcacattaaaaat

SEQ ID NO: 834 - DNA, 20 bp, synthetic construct
  misc_feature 1..20: note = Synthetic oligonucleotide
  source 1..20: mol_type = other DNA
acttttactatatcaatgga

SEQ ID NO: 835 - DNA, 20 bp, synthetic construct
  misc_feature 1..20: note = Synthetic oligonucleotide
  source 1..20: mol_type = other DNA
taggtatttattccctctta

SEQ ID NO: 836 - DNA, 20 bp, synthetic construct
  misc_feature 1..20: note = Synthetic oligonucleotide
  source 1..20: mol_type = other DNA
tcatcacaaaaaccctatta

SEQ ID NO: 837 - DNA, 20 bp, synthetic construct
  misc_feature 1..20: note = Synthetic oligonucleotide
  source 1..20: mol_type = other DNA
tatgtctccatataaaagca

SEQ ID NO: 838 - DNA, 20 bp, synthetic construct
  misc_feature 1..20: note = Synthetic oligonucleotide
  source 1..20: mol_type = other DNA
tctaaattttaaaatttcaa

SEQ ID NO: 839 - DNA, 20 bp, synthetic construct
  misc_feature 1..20: note = Synthetic oligonucleotide
  source 1..20: mol_type = other DNA
gtgattgcttataataccca

SEQ ID NO: 840 - DNA, 20 bp, synthetic construct
  misc_feature 1..20: note = Synthetic oligonucleotide
  source 1..20: mol_type = other DNA
tttatacctactaatatcta

SEQ ID NO: 841 - DNA, 20 bp, synthetic construct
  misc_feature 1..20: note = Synthetic oligonucleotide
  source 1..20: mol_type = other DNA
ttaatatcaaaccctaattc

SEQ ID NO: 842 - DNA, 20 bp, synthetic construct
  misc_feature 1..20: note = Synthetic oligonucleotide
  source 1..20: mol_type = other DNA
tgggtgcatttattttgaac

SEQ ID NO: 843 - DNA, 20 bp, synthetic construct
  misc_feature 1..20: note = Synthetic oligonucleotide
  source 1..20: mol_type = other DNA
aaacaataaataatatttga

SEQ ID NO: 844 - DNA, 20 bp, synthetic construct
  misc_feature 1..20: note = Synthetic oligonucleotide
  source 1..20: mol_type = other DNA
ggcaagataatctcttcatc

SEQ ID NO: 845 - DNA, 20 bp, synthetic construct
  misc_feature 1..20: note = Synthetic oligonucleotide
  source 1..20: mol_type = other DNA
tggtgatcttctaattagat

SEQ ID NO: 846 - DNA, 20 bp, synthetic construct
  misc_feature 1..20: note = Synthetic oligonucleotide
  source 1..20: mol_type = other DNA
tatggattttctactattcc

SEQ ID NO: 847 - DNA, 20 bp, synthetic construct
  misc_feature 1..20: note = Synthetic oligonucleotide
  source 1..20: mol_type = other DNA
atagaattttcctaatttta

SEQ ID NO: 848 - DNA, 20 bp, synthetic construct
  misc_feature 1..20: note = Synthetic oligonucleotide
  source 1..20: mol_type = other DNA
cataaccattctaatttttc

SEQ ID NO: 849 - DNA, 20 bp, synthetic construct
  misc_feature 1..20: note = Synthetic oligonucleotide
  source 1..20: mol_type = other DNA
catttattcatatctagtga

SEQ ID NO: 850 - DNA, 20 bp, synthetic construct
  misc_feature 1..20: note = Synthetic oligonucleotide
  source 1..20: mol_type = other DNA
ttttcttcctctaacaaatc

SEQ ID NO: 851 - DNA, 20 bp, synthetic construct
  misc_feature 1..20: note = Synthetic oligonucleotide
  source 1..20: mol_type = other DNA
ttctttttaacctttatatc

SEQ ID NO: 852 - DNA, 20 bp, synthetic construct
  misc_feature 1..20: note = Synthetic oligonucleotide
  source 1..20: mol_type = other DNA
cttatatttcttaattcccc

SEQ ID NO: 853 - DNA, 20 bp, synthetic construct
  misc_feature 1..20: note = Synthetic oligonucleotide
  source 1..20: mol_type = other DNA
tcatgcttctatcatgctaa

SEQ ID NO: 854 - DNA, 20 bp, synthetic construct
  misc_feature 1..20: note = Synthetic oligonucleotide
  source 1..20: mol_type = other DNA
ttctattttataaatgccga

SEQ ID NO: 855 - DNA, 20 bp, synthetic construct
  misc_feature 1..20: note = Synthetic oligonucleotide
  source 1..20: mol_type = other DNA
ctcttcattttaaaaacacc

SEQ ID NO: 856 - DNA, 20 bp, synthetic construct
  misc_feature 1..20: note = Synthetic oligonucleotide
  source 1..20: mol_type = other DNA
gtttatcaatttaaaacatt

SEQ ID NO: 857 - DNA, 20 bp, synthetic construct
  misc_feature 1..20: note = Synthetic oligonucleotide
  source 1..20: mol_type = other DNA
tctaggccatatggataata

SEQ ID NO: 858 - DNA, 20 bp, synthetic construct
  misc_feature 1..20: note = Synthetic oligonucleotide
  source 1..20: mol_type = other DNA
acagcaaccatctaaattta

SEQ ID NO: 859 - DNA, 20 bp, synthetic construct
  misc_feature 1..20: note = Synthetic oligonucleotide
  source 1..20: mol_type = other DNA
tctacttcttatcattcact

SEQ ID NO: 860 - DNA, 20 bp, synthetic construct
  misc_feature 1..20: note = Synthetic oligonucleotide
  source 1..20: mol_type = other DNA
tttggactttcaaatttctt

SEQ ID NO: 861 - DNA, 20 bp, synthetic construct
  misc_feature 1..20: note = Synthetic oligonucleotide
  source 1..20: mol_type = other DNA
caacttattttcaaatatca

SEQ ID NO: 862 - DNA, 20 bp, synthetic construct
  misc_feature 1..20: note = Synthetic oligonucleotide
  source 1..20: mol_type = other DNA
tttatattcctctataacat

SEQ ID NO: 863 - DNA, 20 bp, synthetic construct
  misc_feature 1..20: note = Synthetic oligonucleotide
  source 1..20: mol_type = other DNA
atctgaattattaattgctt

SEQ ID NO: 864 - DNA, 20 bp, synthetic construct
  misc_feature 1..20: note = Synthetic oligonucleotide
  source 1..20: mol_type = other DNA
gtattatttcctaaagacta

SEQ ID NO: 865 - DNA, 20 bp, synthetic construct
  misc_feature 1..20: note = Synthetic oligonucleotide
  source 1..20: mol_type = other DNA
aagaaacctttattttgcta

SEQ ID NO: 866 - DNA, 20 bp, synthetic construct
  misc_feature 1..20: note = Synthetic oligonucleotide
  source 1..20: mol_type = other DNA
gtagtgtaaatagggaagct

SEQ ID NO: 867 - DNA, 20 bp, synthetic construct
  misc_feature 1..20: note = Synthetic oligonucleotide
  source 1..20: mol_type = other DNA
cacatgtgctctatcctcat

SEQ ID NO: 868 - DNA, 20 bp, synthetic construct
  misc_feature 1..20: note = Synthetic oligonucleotide
  source 1..20: mol_type = other DNA
ttcctgtttgggtctcttag

SEQ ID NO: 869 - DNA, 20 bp, synthetic construct
  misc_feature 1..20: note = Synthetic oligonucleotide
  source 1..20: mol_type = other DNA
cagaaagcttcttcactgac

SEQ ID NO: 870 - DNA, 20 bp, synthetic construct
  misc_feature 1..20: note = Synthetic oligonucleotide
  source 1..20: mol_type = other DNA
tgaaaaaactcctatcccac

SEQ ID NO: 871 - DNA, 20 bp, synthetic construct
  misc_feature 1..20: note = Synthetic oligonucleotide
  source 1..20: mol_type = other DNA
gtaggatcttccaataaatc

SEQ ID NO: 872 - DNA, 20 bp, synthetic construct
  misc_feature 1..20: note = Synthetic oligonucleotide
  source 1..20: mol_type = other DNA
ttgaaagtaataatatggat

SEQ ID NO: 873 - DNA, 20 bp, synthetic construct
  misc_feature 1..20: note = Synthetic oligonucleotide
  source 1..20: mol_type = other DNA
gaactagttgcatttagctt

SEQ ID NO: 874 - DNA, 20 bp, synthetic construct
  misc_feature 1..20: note = Synthetic oligonucleotide
  source 1..20: mol_type = other DNA
cagcatttccagaatgaata

SEQ ID NO: 875 - DNA, 20 bp, synthetic construct
  misc_feature 1..20: note = Synthetic oligonucleotide
  source 1..20: mol_type = other DNA
gttgtcttcatacttgggtt

SEQ ID NO: 876 - DNA, 20 bp, synthetic construct
  misc_feature 1..20: note = Synthetic oligonucleotide
  source 1..20: mol_type = other DNA
cctttgtcttccttttctga

SEQ ID NO: 877 - DNA, 20 bp, synthetic construct
  misc_feature 1..20: note = Synthetic oligonucleotide
  source 1..20: mol_type = other DNA
gcttgtgattctatggaaca

SEQ ID NO: 878 - DNA, 20 bp, synthetic construct
  misc_feature 1..20: note = Synthetic oligonucleotide
  source 1..20: mol_type = other DNA
agcagaatcaactttataaa

SEQ ID NO: 879 - DNA, 20 bp, synthetic construct
  misc_feature 1..20: note = Synthetic oligonucleotide
  source 1..20: mol_type = other DNA
ttaaatcatcatttttgttt

SEQ ID NO: 880 - DNA, 20 bp, synthetic construct
  misc_feature 1..20: note = Synthetic oligonucleotide
  source 1..20: mol_type = other DNA
cagcttcaaactataatgga

SEQ ID NO: 881 - DNA, 20 bp, synthetic construct
  misc_feature 1..20: note = Synthetic oligonucleotide
  source 1..20: mol_type = other DNA
tttacagtatttatattttc

SEQ ID NO: 882 - DNA, 20 bp, synthetic construct
  misc_feature 1..20: note = Synthetic oligonucleotide
  source 1..20: mol_type = other DNA
ggcattactattgaaagcaa

SEQ ID NO: 883 - DNA, 20 bp, synthetic construct
  misc_feature 1..20: note = Synthetic oligonucleotide
  source 1..20: mol_type = other DNA
gtataaagaatctacattta

SEQ ID NO: 884 - DNA, 20 bp, synthetic construct
  misc_feature 1..20: note = Synthetic oligonucleotide
  source 1..20: mol_type = other DNA
caaagacaacaattaaatac

SEQ ID NO: 885 - DNA, 20 bp, synthetic construct
  misc_feature 1..20: note = Synthetic oligonucleotide
  source 1..20: mol_type = other DNA
ctcttcttaattaacttcca

SEQ ID NO: 886 - DNA, 20 bp, synthetic construct
  misc_feature 1..20: note = Synthetic oligonucleotide
  source 1..20: mol_type = other DNA
gtcattcttaacatagataa

SEQ ID NO: 887 - DNA, 20 bp, synthetic construct
  misc_feature 1..20: note = Synthetic oligonucleotide
  source 1..20: mol_type = other DNA
aagatctaatttaactgtca

SEQ ID NO: 888 - DNA, 20 bp, synthetic construct
  misc_feature 1..20: note = Synthetic oligonucleotide
  source 1..20: mol_type = other DNA
tgtcatttccccatacatat

SEQ ID NO: 889 - DNA, 20 bp, synthetic construct
  misc_feature 1..20: note = Synthetic oligonucleotide
  source 1..20: mol_type = other DNA
aaatttagtcataatagtac

SEQ ID NO: 890 - DNA, 20 bp, synthetic construct
  misc_feature 1..20: note = Synthetic oligonucleotide
  source 1..20: mol_type = other DNA
aatatatcaacaaatacaaa

SEQ ID NO: 891 - DNA, 20 bp, synthetic construct
  misc_feature 1..20: note = Synthetic oligonucleotide
  source 1..20: mol_type = other DNA
gaggacactttaattatgaa

SEQ ID NO: 892 - DNA, 20 bp, synthetic construct
  misc_feature 1..20: note = Synthetic oligonucleotide
  source 1..20: mol_type = other DNA
ctttctgtttctgtgagttt

SEQ ID NO: 893 - DNA, 20 bp, synthetic construct
  misc_feature 1..20: note = Synthetic oligonucleotide
  source 1..20: mol_type = other DNA
gaccatttttatctgtgtta

SEQ ID NO: 894 - DNA, 20 bp, synthetic construct
  misc_feature 1..20: note = Synthetic oligonucleotide
  source 1..20: mol_type = other DNA
tcaggcttcttatattcatt

SEQ ID NO: 895 - DNA, 20 bp, synthetic construct
  misc_feature 1..20: note = Synthetic oligonucleotide
  source 1..20: mol_type = other DNA
acattatcttttactaagta

SEQ ID NO: 896 - DNA, 20 bp, synthetic construct
  misc_feature 1..20: note = Synthetic oligonucleotide
  source 1..20: mol_type = other DNA
ccttctcattccattgccaa

SEQ ID NO: 897 - DNA, 20 bp, synthetic construct
  misc_feature 1..20: note = Synthetic oligonucleotide
  source 1..20: mol_type = other DNA
ttcttcttttcatcaaagac

SEQ ID NO: 898 - DNA, 20 bp, synthetic construct
  misc_feature 1..20: note = Synthetic oligonucleotide
  source 1..20: mol_type = other DNA
ccttaacattatattagtta

SEQ ID NO: 899 - DNA, 20 bp, synthetic construct
  misc_feature 1..20: note = Synthetic oligonucleotide
  source 1..20: mol_type = other DNA
atcagtcattccaaatgtta

SEQ ID NO: 900 - DNA, 20 bp, synthetic construct
  misc_feature 1..20: note = Synthetic oligonucleotide
  source 1..20: mol_type = other DNA
ataaaatctctcatttccaa

SEQ ID NO: 901 - DNA, 20 bp, synthetic construct
  misc_feature 1..20: note = Synthetic oligonucleotide
  source 1..20: mol_type = other DNA
cagaatttcttaaactgccc

SEQ ID NO: 902 - DNA, 20 bp, synthetic construct
  misc_feature 1..20: note = Synthetic oligonucleotide
  source 1..20: mol_type = other DNA
atttgatacacaatagctcc

SEQ ID NO: 903 - DNA, 20 bp, synthetic construct
  misc_feature 1..20: note = Synthetic oligonucleotide
  source 1..20: mol_type = other DNA
tttatcattattaatgtcta

SEQ ID NO: 904 - DNA, 20 bp, synthetic construct
  misc_feature 1..20: note = Synthetic oligonucleotide
  source 1..20: mol_type = other DNA
gatgttttttaatctattaa

SEQ ID NO: 905 - DNA, 20 bp, synthetic construct
  misc_feature 1..20: note = Synthetic oligonucleotide
  source 1..20: mol_type = other DNA
acttaaaaacttactcttta

SEQ ID NO: 906 - DNA, 20 bp, synthetic construct
  misc_feature 1..20: note = Synthetic oligonucleotide
  source 1..20: mol_type = other DNA
tccatttaatccattctgca

SEQ ID NO: 907 - DNA, 20 bp, synthetic construct
  misc_feature 1..20: note = Synthetic oligonucleotide
  source 1..20: mol_type = other DNA
cttctactctcctcatccta

SEQ ID NO: 908 - DNA, 20 bp, synthetic construct
  misc_feature 1..20: note = Synthetic oligonucleotide
  source 1..20: mol_type = other DNA
ttcatatttaataaaaagca

SEQ ID NO: 909 - DNA, 20 bp, synthetic construct
  misc_feature 1..20: note = Synthetic oligonucleotide
  source 1..20: mol_type = other DNA
tttgccatttctataactca

SEQ ID NO: 910 - DNA, 20 bp, synthetic construct
  misc_feature 1..20: note = Synthetic oligonucleotide
  source 1..20: mol_type = other DNA
tgatagttcctaatttctcc

SEQ ID NO: 911 - DNA, 20 bp, synthetic construct
  misc_feature 1..20: note = Synthetic oligonucleotide
  source 1..20: mol_type = other DNA
tgagaacttttactatatca

SEQ ID NO: 912 - DNA, 20 bp, synthetic construct
  misc_feature 1..20: note = Synthetic oligonucleotide
  source 1..20: mol_type = other DNA
caattttaacttaatttcct

SEQ ID NO: 913 - DNA, 20 bp, synthetic construct
  misc_feature 1..20: note = Synthetic oligonucleotide
  source 1..20: mol_type = other DNA
cttcatcatcacaaaaaccc

SEQ ID NO: 914 - DNA, 20 bp, synthetic construct
  misc_feature 1..20: note = Synthetic oligonucleotide
  source 1..20: mol_type = other DNA
ataattgtcattattatatt

SEQ ID NO: 915 - DNA, 20 bp, synthetic construct
  misc_feature 1..20: note = Synthetic oligonucleotide
  source 1..20: mol_type = other DNA
ttctaaattttaaaatttca

SEQ ID NO: 916 - DNA, 20 bp, synthetic construct
  misc_feature 1..20: note = Synthetic oligonucleotide
  source 1..20: mol_type = other DNA
actctatttttatatagaga

SEQ ID NO: 917 - DNA, 20 bp, synthetic construct
  misc_feature 1..20: note = Synthetic oligonucleotide
  source 1..20: mol_type = other DNA
ccattattttatacctacta

SEQ ID NO: 918 - DNA, 20 bp, synthetic construct
  misc_feature 1..20: note = Synthetic oligonucleotide
  source 1..20: mol_type = other DNA
aagttaatatcaaaccctaa

SEQ ID NO: 919 - DNA, 20 bp, synthetic construct
  misc_feature 1..20: note = Synthetic oligonucleotide
  source 1..20: mol_type = other DNA
catcctttccatcctaagca

SEQ ID NO: 920 - DNA, 20 bp, synthetic construct
  misc_feature 1..20: note = Synthetic oligonucleotide
  source 1..20: mol_type = other DNA
ttgtaaacaataaataatat

SEQ ID NO: 921 - DNA, 20 bp, synthetic construct
  misc_feature 1..20: note = Synthetic oligonucleotide
  source 1..20: mol_type = other DNA
ctaccatcttcctttggcaa

SEQ ID NO: 922 - DNA, 20 bp, synthetic construct
  misc_feature 1..20: note = Synthetic oligonucleotide
  source 1..20: mol_type = other DNA
ctaagaaccttaatcagtca

SEQ ID NO: 923 - DNA, 20 bp, synthetic construct
  misc_feature 1..20: note = Synthetic oligonucleotide
  source 1..20: mol_type = other DNA
tagggaatatcctataggca

SEQ ID NO: 924 - DNA, 20 bp, synthetic construct
  misc_feature 1..20: note = Synthetic oligonucleotide
  source 1..20: mol_type = other DNA
aatgtgctttcatttattta

SEQ ID NO: 925 - DNA, 20 bp, synthetic construct
  misc_feature 1..20: note = Synthetic oligonucleotide
  source 1..20: mol_type = other DNA
gtttttaattctcttagata

SEQ ID NO: 926 - DNA, 20 bp, synthetic construct
  misc_feature 1..20: note = Synthetic oligonucleotide
  source 1..20: mol_type = other DNA
tatttacccacatttattca

SEQ ID NO: 927 - DNA, 20 bp, synthetic construct
  misc_feature 1..20: note = Synthetic oligonucleotide
  source 1..20: mol_type = other DNA
attttcttcctctaacaaat

SEQ ID NO: 928 - DNA, 20 bp, synthetic construct
  misc_feature 1..20: note = Synthetic oligonucleotide
  source 1..20: mol_type = other DNA
aggcttctttttaaccttta

SEQ ID NO: 929 - DNA, 20 bp, synthetic construct
  misc_feature 1..20: note = Synthetic oligonucleotide
  source 1..20: mol_type = other DNA
cataaattaaattctaccca

SEQ ID NO: 930 - DNA, 20 bp, synthetic construct
  misc_feature 1..20: note = Synthetic oligonucleotide
  source 1..20: mol_type = other DNA
aggattctacattcttgcta

SEQ ID NO: 931 - DNA, 20 bp, synthetic construct
  misc_feature 1..20: note = Synthetic oligonucleotide
  source 1..20: mol_type = other DNA
attctattttataaatgccg

SEQ ID NO: 932 - DNA, 20 bp, synthetic construct
  misc_feature 1..20: note = Synthetic oligonucleotide
  source 1..20: mol_type = other DNA
tctcttcattttaaaaacac

SEQ ID NO: 933 - DNA, 20 bp, synthetic construct
  misc_feature 1..20: note = Synthetic oligonucleotide
  source 1..20: mol_type = other DNA
atccagtatttatttagaga

SEQ ID NO: 934 - DNA, 20 bp, synthetic construct
  misc_feature 1..20: note = Synthetic oligonucleotide
  source 1..20: mol_type = other DNA
gcttatcacacatcttgaac

SEQ ID NO: 935 - DNA, 20 bp, synthetic construct
  misc_feature 1..20: note = Synthetic oligonucleotide
  source 1..20: mol_type = other DNA
gttttattctaaaattgtga

SEQ ID NO: 936 - DNA, 20 bp, synthetic construct
  misc_feature 1..20: note = Synthetic oligonucleotide
  source 1..20: mol_type = other DNA
gtctacttcttatcattcac

SEQ ID NO: 937 - DNA, 20 bp, synthetic construct
  misc_feature 1..20: note = Synthetic oligonucleotide
  source 1..20: mol_type = other DNA
ttgcttctatatcatacaaa

SEQ ID NO: 938 - DNA, 20 bp, synthetic construct
  misc_feature 1..20: note = Synthetic oligonucleotide
  source 1..20: mol_type = other DNA
agtaactattttcttagtta

SEQ ID NO: 939 - DNA, 20 bp, synthetic construct
  misc_feature 1..20: note = Synthetic oligonucleotide
  source 1..20: mol_type = other DNA
acttcaaatttatattcctc

SEQ ID NO: 940 - DNA, 20 bp, synthetic construct
  misc_feature 1..20: note = Synthetic oligonucleotide
  source 1..20: mol_type = other DNA
aaattatgccatattagtca

SEQ ID NO: 941 - DNA, 20 bp, synthetic construct
  misc_feature 1..20: note = Synthetic oligonucleotide
  source 1..20: mol_type = other DNA
tctattcattcaaattgtat

SEQ ID NO: 942 - DNA, 20 bp, synthetic construct
  misc_feature 1..20: note = Synthetic oligonucleotide
  source 1..20: mol_type = other DNA
ctctaaaattccttttgctt

SEQ ID NO: 943 - DNA, 20 bp, synthetic construct
  misc_feature 1..20: note = Synthetic oligonucleotide
  source 1..20: mol_type = other DNA
agtagtgtaaatagggaagc

SEQ ID NO: 944 - DNA, 20 bp, synthetic construct
  misc_feature 1..20: note = Synthetic oligonucleotide
  source 1..20: mol_type = other DNA
gtaaaatctcacatgtgctc

SEQ ID NO: 945 - DNA, 20 bp, synthetic construct
  misc_feature 1..20: note = Synthetic oligonucleotide
  source 1..20: mol_type = other DNA
ttttcatcatcctcatcctt

SEQ ID NO: 946 - DNA, 20 bp, synthetic construct
  misc_feature 1..20: note = Synthetic oligonucleotide
  source 1..20: mol_type = other DNA
gcttagacagaacacagtca

SEQ ID NO: 947 - DNA, 20 bp, synthetic construct
  misc_feature 1..20: note = Synthetic oligonucleotide
  source 1..20: mol_type = other DNA
ctgaaaaaactcctatccca

SEQ ID NO: 948 - DNA, 20 bp, synthetic construct
  misc_feature 1..20: note = Synthetic oligonucleotide
  source 1..20: mol_type = other DNA
tggctatactcattgctctt

SEQ ID NO: 949 - DNA, 20 bp, synthetic construct
  misc_feature 1..20: note = Synthetic oligonucleotide
  source 1..20: mol_type = other DNA
aactaaggctcacaataaaa

SEQ ID NO: 950 - DNA, 20 bp, synthetic construct
  misc_feature 1..20: note = Synthetic oligonucleotide
  source 1..20: mol_type = other DNA
ggagctccaatatcaaccgt

SEQ ID NO: 951 - DNA, 20 bp, synthetic construct
  misc_feature 1..20: note = Synthetic oligonucleotide
  source 1..20: mol_type = other DNA
gcagcatttccagaatgaat

SEQ ID NO: 952 - DNA, 20 bp, synthetic construct
  misc_feature 1..20: note = Synthetic oligonucleotide
  source 1..20: mol_type = other DNA
tgatatctttccctttgtct

SEQ ID NO: 953 - DNA, 20 bp, synthetic construct
  misc_feature 1..20: note = Synthetic oligonucleotide
  source 1..20: mol_type = other DNA
aaacaactctttaatgcttg

SEQ ID NO: 954 - DNA, 20 bp, synthetic construct
  misc_feature 1..20: note = Synthetic oligonucleotide
  source 1..20: mol_type = other DNA
tgcaggataaagcagaatca

SEQ ID NO: 955 - DNA, 20 bp, synthetic construct
  misc_feature 1..20: note = Synthetic oligonucleotide
  source 1..20: mol_type = other DNA
cttaaatcatcatttttgtt

SEQ ID NO: 956 - DNA, 20 bp, synthetic construct
  misc_feature 1..20: note = Synthetic oligonucleotide
  source 1..20: mol_type = other DNA
gtgacagcttcaaactataa

SEQ ID NO: 957 - DNA, 20 bp, synthetic construct
  misc_feature 1..20: note = Synthetic oligonucleotide
  source 1..20: mol_type = other DNA
aatgaactttttacagtatt

SEQ ID NO: 958 - DNA, 20 bp, synthetic construct
  misc_feature 1..20: note = Synthetic oligonucleotide
  source 1..20: mol_type = other DNA
caatgataaggcattactat

SEQ ID NO: 959 - DNA, 20 bp, synthetic construct
  misc_feature 1..20: note = Synthetic oligonucleotide
  source 1..20: mol_type = other DNA
cagtataaagaatctacatt

SEQ ID NO: 960 - DNA, 20 bp, synthetic construct
  misc_feature 1..20: note = Synthetic oligonucleotide
  source 1..20: mol_type = other DNA
aaagatagaaacaaagacaa

SEQ ID NO: 961 - DNA, 20 bp, synthetic construct
  misc_feature 1..20: note = Synthetic oligonucleotide
  source 1..20: mol_type = other DNA
actcttcttaattaacttcc

SEQ ID NO: 962 - DNA, 20 bp, synthetic construct
  misc_feature 1..20: note = Synthetic oligonucleotide
  source 1..20: mol_type = other DNA
atgtcattcttaacatagat

SEQ ID NO: 963 - DNA, 20 bp, synthetic construct
  misc_feature 1..20: note = Synthetic oligonucleotide
  source 1..20: mol_type = other DNA
ctttatttatatccaactca

SEQ ID NO: 964 - DNA, 20 bp, synthetic construct
  misc_feature 1..20: note = Synthetic oligonucleotide
  source 1..20: mol_type = other DNA
ggcaacaaaatcatgaacaa

SEQ ID NO: 965 - DNA, 20 bp, synthetic construct
  misc_feature 1..20: note = Synthetic oligonucleotide
  source 1..20: mol_type = other DNA
ttatattttaaatttagtca

SEQ ID NO: 966 - DNA, 20 bp, synthetic construct
  misc_feature 1..20: note = Synthetic oligonucleotide
  source 1..20: mol_type = other DNA
tggttaatttataattaacc

SEQ ID NO: 967 - DNA, 20 bp, synthetic construct
  misc_feature 1..20: note = Synthetic oligonucleotide
  source 1..20: mol_type = other DNA
ctgttttccataattgctga

SEQ ID NO: 968 - DNA, 20 bp, synthetic construct
  misc_feature 1..20: note = Synthetic oligonucleotide
  source 1..20: mol_type = other DNA
ccaacattttccattcctcc

SEQ ID NO: 969 - DNA, 20 bp, synthetic construct
  misc_feature 1..20: note = Synthetic oligonucleotide
  source 1..20: mol_type = other DNA
ctttttactttattctgcca

SEQ ID NO: 970 - DNA, 20 bp, synthetic construct
  misc_feature 1..20: note = Synthetic oligonucleotide
  source 1..20: mol_type = other DNA
cccaagagatcatttagtca

SEQ ID NO: 971 - DNA, 20 bp, synthetic construct
  misc_feature 1..20: note = Synthetic oligonucleotide
  source 1..20: mol_type = other DNA
attacattatcttttactaa

SEQ ID NO: 972 - DNA, 20 bp, synthetic construct
  misc_feature 1..20: note = Synthetic oligonucleotide
  source 1..20: mol_type = other DNA
aacttattaataattattta

SEQ ID NO: 973 - DNA, 20 bp, synthetic construct
  misc_feature 1..20: note = Synthetic oligonucleotide
  source 1..20: mol_type = other DNA
attctggattttaataatca

SEQ ID NO: 974 - DNA, 20 bp, synthetic construct
  misc_feature 1..20: note = Synthetic oligonucleotide
  source 1..20: mol_type = other DNA
gtttccttaacattatatta

SEQ ID NO: 975 - DNA, 20 bp, synthetic construct
  misc_feature 1..20: note = Synthetic oligonucleotide
  source 1..20: mol_type = other DNA
aatcatatttcaccagacta

SEQ ID NO: 976 - DNA, 20 bp, synthetic construct
  misc_feature 1..20: note = Synthetic oligonucleotide
  source 1..20: mol_type = other DNA
ttcaaatattttctaggcct

SEQ ID NO: 977 - DNA, 20 bp, synthetic construct
  misc_feature 1..20: note = Synthetic oligonucleotide
  source 1..20: mol_type = other DNA
tcagaatttcttaaactgcc

SEQ ID NO: 978 - DNA, 20 bp, synthetic construct
  misc_feature 1..20: note = Synthetic oligonucleotide
  source 1..20: mol_type = other DNA
cataatttctcattcagcca

SEQ ID NO: 979 - DNA, 20 bp, synthetic construct
  misc_feature 1..20: note = Synthetic oligonucleotide
  source 1..20: mol_type = other DNA
atacattttatcattattaa

SEQ ID NO: 980 - DNA, 20 bp, synthetic construct
  misc_feature 1..20: note = Synthetic oligonucleotide
  source 1..20: mol_type = other DNA
ataaaccttttataatatca

SEQ ID NO: 981 - DNA, 20 bp, synthetic construct
  misc_feature 1..20: note = Synthetic oligonucleotide
  source 1..20: mol_type = other DNA
gacacttaaaaacttactct

SEQ ID NO: 982 - DNA, 20 bp, synthetic construct
  misc_feature 1..20: note = Synthetic oligonucleotide
  source 1..20: mol_type = other DNA
gtttggctccatttaatcca

SEQ ID NO: 983 - DNA, 20 bp, synthetic construct
  misc_feature 1..20: note = Synthetic oligonucleotide
  source 1..20: mol_type = other DNA
atctacctctcttctactct

SEQ ID NO: 984 - DNA, 20 bp, synthetic construct
  misc_feature 1..20: note = Synthetic oligonucleotide
  source 1..20: mol_type = other DNA
actttcatatttaataaaaa

SEQ ID NO: 985 - DNA, 20 bp, synthetic construct
  misc_feature 1..20: note = Synthetic oligonucleotide
  source 1..20: mol_type = other DNA
ttattattctattattgacc

SEQ ID NO: 986 - DNA, 20 bp, synthetic construct
  misc_feature 1..20: note = Synthetic oligonucleotide
  source 1..20: mol_type = other DNA
gccatgtaatttactatgat

SEQ ID NO: 987 - DNA, 20 bp, synthetic construct
  misc_feature 1..20: note = Synthetic oligonucleotide
  source 1..20: mol_type = other DNA
atgagaacttttactatatc

SEQ ID NO: 988 - DNA, 20 bp, synthetic construct
  misc_feature 1..20: note = Synthetic oligonucleotide
  source 1..20: mol_type = other DNA
tttcatgcaaataaatttta

SEQ ID NO: 989 - DNA, 20 bp, synthetic construct
  misc_feature 1..20: note = Synthetic oligonucleotide
  source 1..20: mol_type = other DNA
cacttcatcatcacaaaaac

SEQ ID NO: 990 - DNA, 20 bp, synthetic construct
  misc_feature 1..20: note = Synthetic oligonucleotide
  source 1..20: mol_type = other DNA
ctgtgattcataattgtcat

SEQ ID NO: 991 - DNA, 20 bp, synthetic construct
  misc_feature 1..20: note = Synthetic oligonucleotide
  source 1..20: mol_type = other DNA
atattgcaaataacaacaca

SEQ ID NO: 992 - DNA, 20 bp, synthetic construct
  misc_feature 1..20: note = Synthetic oligonucleotide
  source 1..20: mol_type = other DNA
actatttctttatcaagcaa

SEQ ID NO: 993 - DNA, 20 bp, synthetic construct
  misc_feature 1..20: note = Synthetic oligonucleotide
  source 1..20: mol_type = other DNA
aaccattattttatacctac

SEQ ID NO: 994 - DNA, 20 bp, synthetic construct
  misc_feature 1..20: note = Synthetic oligonucleotide
  source 1..20: mol_type = other DNA
tacaaaattttaaacacttt

SEQ ID NO: 995 - DNA, 20 bp, synthetic construct
  misc_feature 1..20: note = Synthetic oligonucleotide
  source 1..20: mol_type = other DNA
attgcacttattcctagaac

SEQ ID NO: 996 - DNA, 20 bp, synthetic construct
  misc_feature 1..20: note = Synthetic oligonucleotide
  source 1..20: mol_type = other DNA
actttgtaaacaataaataa

SEQ ID NO: 997 - DNA, 20 bp, synthetic construct
  misc_feature 1..20: note = Synthetic oligonucleotide
  source 1..20: mol_type = other DNA
tctaccatcttcctttggca

SEQ ID NO: 998 - DNA, 20 bp, synthetic construct
  misc_feature 1..20: note = Synthetic oligonucleotide
  source 1..20: mol_type = other DNA
cctaagaaccttaatcagtc

SEQ ID NO: 999 - DNA, 20 bp, synthetic construct
  misc_feature 1..20: note = Synthetic oligonucleotide
  source 1..20: mol_type = other DNA
cctataacttatcctaggga

SEQ ID NO: 1000 - DNA, 20 bp, synthetic construct
  misc_feature 1..20: note = Synthetic oligonucleotide
  source 1..20: mol_type = other DNA
attttcctctaatctatgaa

SEQ ID NO: 1001 - DNA, 20 bp, synthetic construct
  misc_feature 1..20: note = Synthetic oligonucleotide
  source 1..20: mol_type = other DNA
gttcacttaatataatatat

SEQ ID NO: 1002 - DNA, 20 bp, synthetic construct
  misc_feature 1..20: note = Synthetic oligonucleotide
  source 1..20: mol_type = other DNA
gtatttacccacatttattc

SEQ ID NO: 1003 - DNA, 20 bp, synthetic construct
  misc_feature 1..20: note = Synthetic oligonucleotide
  source 1..20: mol_type = other DNA
attttttaaacaattatctt

SEQ ID NO: 1004 - DNA, 20 bp, synthetic construct
  misc_feature 1..20: note = Synthetic oligonucleotide
  source 1..20: mol_type = other DNA
atattatattcaaatacaaa

SEQ ID NO: 1005 - DNA, 20 bp, synthetic construct
  misc_feature 1..20: note = Synthetic oligonucleotide
  source 1..20: mol_type = other DNA
tttcataaattaaattctac

SEQ ID NO: 1006 - DNA, 20 bp, synthetic construct
  misc_feature 1..20: note = Synthetic oligonucleotide
  source 1..20: mol_type = other DNA
tggttattatacaataatta

SEQ ID NO: 1007 - DNA, 20 bp, synthetic construct
  misc_feature 1..20: note = Synthetic oligonucleotide
  source 1..20: mol_type = other DNA
actttttttactattaggga

SEQ ID NO: 1008 - DNA, 20 bp, synthetic construct
  misc_feature 1..20: note = Synthetic oligonucleotide
  source 1..20: mol_type = other DNA
tgtgatttcaacattaagaa

SEQ ID NO: 1009 - DNA, 20 bp, synthetic construct
  misc_feature 1..20: note = Synthetic oligonucleotide
  source 1..20: mol_type = other DNA
aatattttctcttaattgca

SEQ ID NO: 1010 - DNA, 20 bp, synthetic construct
  misc_feature 1..20: note = Synthetic oligonucleotide
  source 1..20: mol_type = other DNA
caggtcttaataaattttgc

SEQ ID NO: 1011 - DNA, 20 bp, synthetic construct
  misc_feature 1..20: note = Synthetic oligonucleotide
  source 1..20: mol_type = other DNA
agtcatataatcatctgcga

SEQ ID NO: 1012 - DNA, 20 bp, synthetic construct
  misc_feature 1..20: note = Synthetic oligonucleotide
  source 1..20: mol_type = other DNA
attatattaatattttgatc

SEQ ID NO: 1013 - DNA, 20 bp, synthetic construct
  misc_feature 1..20: note = Synthetic oligonucleotide
  source 1..20: mol_type = other DNA
gcctcatattcaattatata

SEQ ID NO: 1014 - DNA, 20 bp, synthetic construct
  misc_feature 1..20: note = Synthetic oligonucleotide
  source 1..20: mol_type = other DNA
actgttctttctaattggta

SEQ ID NO: 1015 - DNA, 20 bp, synthetic construct
  misc_feature 1..20: note = Synthetic oligonucleotide
  source 1..20: mol_type = other DNA
gatcaaaattctatttgaca

SEQ ID NO: 1016 - DNA, 20 bp, synthetic construct
  misc_feature 1..20: note = Synthetic oligonucleotide
  source 1..20: mol_type = other DNA
acccagttttttcattgcat

SEQ ID NO: 1017 - DNA, 20 bp, synthetic construct
  misc_feature 1..20: note = Synthetic oligonucleotide
  source 1..20: mol_type = other DNA
tacattttctcatacagtaa

SEQ ID NO: 1018 - DNA, 20 bp, synthetic construct
  misc_feature 1..20: note = Synthetic oligonucleotide
  source 1..20: mol_type = other DNA
ttcttttcatatattactcc

SEQ ID NO: 1019 - DNA, 20 bp, synthetic construct
  misc_feature 1..20: note = Synthetic oligonucleotide
  source 1..20: mol_type = other DNA
taagtagtgtaaatagggaa

SEQ ID NO: 1020 - DNA, 20 bp, synthetic construct
  misc_feature 1..20: note = Synthetic oligonucleotide
  source 1..20: mol_type = other DNA
ggctaaacaatactgcagga

SEQ ID NO: 1021 - DNA, 20 bp, synthetic construct
  misc_feature 1..20: note = Synthetic oligonucleotide
  source 1..20: mol_type = other DNA
tagaaagtaaaatctcacat

SEQ ID NO: 1022 - DNA, 20 bp, synthetic construct
  misc_feature 1..20: note = Synthetic oligonucleotide
  source 1..20: mol_type = other DNA
attttcatcatcctcatcct

SEQ ID NO: 1023 - DNA, 20 bp, synthetic construct
  misc_feature 1..20: note = Synthetic oligonucleotide
  source 1..20: mol_type = other DNA
acaactgcaatcctattagc

SEQ ID NO: 1024 - DNA, 20 bp, synthetic construct
  misc_feature 1..20: note = Synthetic oligonucleotide
  source 1..20: mol_type = other DNA
agctctttttcacttttgga

SEQ ID NO: 1025 - DNA, 20 bp, synthetic construct
  misc_feature 1..20: note = Synthetic oligonucleotide
  source 1..20: mol_type = other DNA
ctggctatactcattgctct

SEQ ID NO: 1026 - DNA, 20 bp, synthetic construct
  misc_feature 1..20: note = Synthetic oligonucleotide
  source 1..20: mol_type = other DNA
gttccattaaactaaggctc

SEQ ID NO: 1027 - DNA, 20 bp, synthetic construct
  misc_feature 1..20: note = Synthetic oligonucleotide
  source 1..20: mol_type = other DNA
tcaagggattcctcaggttc

SEQ ID NO: 1028 - DNA, 20 bp, synthetic construct
  misc_feature 1..20: note = Synthetic oligonucleotide
  source 1..20: mol_type = other DNA
acttgaaaaccatatgcaac

SEQ ID NO: 1029 - DNA, 20 bp, synthetic construct
  misc_feature 1..20: note = Synthetic oligonucleotide
  source 1..20: mol_type = other DNA
acaggttgtcttcatacttg

SEQ ID NO: 1030 - DNA, 20 bp, synthetic construct
  misc_feature 1..20: note = Synthetic oligonucleotide
  source 1..20: mol_type = other DNA
ctgatatctttccctttgtc

SEQ ID NO: 1031 - DNA, 20 bp, synthetic construct
  misc_feature 1..20: note = Synthetic oligonucleotide
  source 1..20: mol_type = other DNA
aaaacaactctttaatgctt

SEQ ID NO: 1032 - DNA, 20 bp, synthetic construct
  misc_feature 1..20: note = Synthetic oligonucleotide
  source 1..20: mol_type = other DNA
gcttaaatcatcatttttgt

SEQ ID NO: 1033 - DNA, 20 bp, synthetic construct
  misc_feature 1..20: note = Synthetic oligonucleotide
  source 1..20: mol_type = other DNA
agtgacagcttcaaactata

SEQ ID NO: 1034 - DNA, 20 bp, synthetic construct
  misc_feature 1..20: note = Synthetic oligonucleotide
  source 1..20: mol_type = other DNA
cttttaatttctcattttac

SEQ ID NO: 1035 - DNA, 20 bp, synthetic construct
  misc_feature 1..20: note = Synthetic oligonucleotide
  source 1..20: mol_type = other DNA
gcctctttcaatgataaggc

SEQ ID NO: 1036 - DNA, 20 bp, synthetic construct
  misc_feature 1..20: note = Synthetic oligonucleotide
  source 1..20: mol_type = other DNA
agcttcagtataaagaatct

SEQ ID NO: 1037 - DNA, 20 bp, synthetic construct
  misc_feature 1..20: note = Synthetic oligonucleotide
  source 1..20: mol_type = other DNA
tggcatttcaaagatagaaa

SEQ ID NO: 1038 - DNA, 20 bp, synthetic construct
  misc_feature 1..20: note = Synthetic oligonucleotide
  source 1..20: mol_type = other DNA
cactcttcttaattaacttc

SEQ ID NO: 1039 - DNA, 20 bp, synthetic construct
  misc_feature 1..20: note = Synthetic oligonucleotide
  source 1..20: mol_type = other DNA
aggaagattttaaattgcac

SEQ ID NO: 1040 - DNA, 20 bp, synthetic construct
  misc_feature 1..20: note = Synthetic oligonucleotide
  source 1..20: mol_type = other DNA
tttcttgtatttacttgcct

SEQ ID NO: 1041 - DNA, 20 bp, synthetic construct
  misc_feature 1..20: note = Synthetic oligonucleotide
  source 1..20: mol_type = other DNA
aactttctaacacttaggca

SEQ ID NO: 1042 - DNA, 20 bp, synthetic construct
  misc_feature 1..20: note = Synthetic oligonucleotide
  source 1..20: mol_type = other DNA
atgaaggtatttaaaatcta

SEQ ID NO: 1043 - DNA, 20 bp, synthetic construct
  misc_feature 1..20: note = Synthetic oligonucleotide
  source 1..20: mol_type = other DNA
gagaacatttttaaattaac

SEQ ID NO: 1044 - DNA, 20 bp, synthetic construct
  misc_feature 1..20: note = Synthetic oligonucleotide
  source 1..20: mol_type = other DNA
agatgtaattctattacata

SEQ ID NO: 1045 - DNA, 20 bp, synthetic construct
  misc_feature 1..20: note = Synthetic oligonucleotide
  source 1..20: mol_type = other DNA
tcaattatatttaattgaca

SEQ ID NO: 1046 - DNA, 20 bp, synthetic construct
  misc_feature 1..20: note = Synthetic oligonucleotide
  source 1..20: mol_type = other DNA
gataaaatctctaacaatta

SEQ ID NO: 1047 - DNA, 20 bp, synthetic construct
  misc_feature 1..20: note = Synthetic oligonucleotide
  source 1..20: mol_type = other DNA
gcaaattaaaataatgggtt

SEQ ID NO: 1048 - DNA, 20 bp, synthetic construct
  misc_feature 1..20: note = Synthetic oligonucleotide
  source 1..20: mol_type = other DNA
tttttaacaattataagtaa

SEQ ID NO: 1049 - DNA, 20 bp, synthetic construct
  misc_feature 1..20: note = Synthetic oligonucleotide
  source 1..20: mol_type = other DNA
caccatcattcacttagatt

SEQ ID NO: 1050 - DNA, 20 bp, synthetic construct
  misc_feature 1..20: note = Synthetic oligonucleotide
  source 1..20: mol_type = other DNA
caagaactcattcaaccgtc

SEQ ID NO: 1051 - DNA, 20 bp, synthetic construct
  misc_feature 1..20: note = Synthetic oligonucleotide
  source 1..20: mol_type = other DNA
ccatttattccttatagcaa

SEQ ID NO: 1052 - DNA, 20 bp, synthetic construct
  misc_feature 1..20: note = Synthetic oligonucleotide
  source 1..20: mol_type = other DNA
ggtattcaaatcatatttca

SEQ ID NO: 1053 - DNA, 20 bp, synthetic construct
  misc_feature 1..20: note = Synthetic oligonucleotide
  source 1..20: mol_type = other DNA
attcaaatattttctaggcc

SEQ ID NO: 1054 - DNA, 20 bp, synthetic construct
  misc_feature 1..20: note = Synthetic oligonucleotide
  source 1..20: mol_type = other DNA
caggaagcaaatacaagccc

SEQ ID NO: 1055 - DNA, 20 bp, synthetic construct
  misc_feature 1..20: note = Synthetic oligonucleotide
  source 1..20: mol_type = other DNA
atcacaagcataatttctca

SEQ ID NO: 1056 - DNA, 20 bp, synthetic construct
  misc_feature 1..20: note = Synthetic oligonucleotide
  source 1..20: mol_type = other DNA
tttttgctaatcttacagca

SEQ ID NO: 1057 - DNA, 20 bp, synthetic construct
  misc_feature 1..20: note = Synthetic oligonucleotide
  source 1..20: mol_type = other DNA
ggcagataaaccttttataa

SEQ ID NO: 1058 - DNA, 20 bp, synthetic construct
  misc_feature 1..20: note = Synthetic oligonucleotide
  source 1..20: mol_type = other DNA
tgacacttaaaaacttactc

SEQ ID NO: 1059 - DNA, 20 bp, synthetic construct
  misc_feature 1..20: note = Synthetic oligonucleotide
  source 1..20: mol_type = other DNA
ctaatagtccatctagatta

SEQ ID NO: 1060 - DNA, 20 bp, synthetic construct
  misc_feature 1..20: note = Synthetic oligonucleotide
  source 1..20: mol_type = other DNA
gtggcatttttctttttgaa

SEQ ID NO: 1061 - DNA, 20 bp, synthetic construct
  misc_feature 1..20: note = Synthetic oligonucleotide
  source 1..20: mol_type = other DNA
atgactttcatatttaataa

SEQ ID NO: 1062 - DNA, 20 bp, synthetic construct
  misc_feature 1..20: note = Synthetic oligonucleotide
  source 1..20: mol_type = other DNA
gaagtttaaaactttagtgc

SEQ ID NO: 1063 - DNA, 20 bp, synthetic construct
  misc_feature 1..20: note = Synthetic oligonucleotide
  source 1..20: mol_type = other DNA
tttattactttacagtgcta

SEQ ID NO: 1064 - DNA, 20 bp, synthetic construct
  misc_feature 1..20: note = Synthetic oligonucleotide
  source 1..20: mol_type = other DNA
ataagacaacacattttcaa

SEQ ID NO: 1065 - DNA, 20 bp, synthetic construct
  misc_feature 1..20: note = Synthetic oligonucleotide
  source 1..20: mol_type = other DNA
aatataagctcaaattgcat

SEQ ID NO: 1066 - DNA, 20 bp, synthetic construct
  misc_feature 1..20: note = Synthetic oligonucleotide
  source 1..20: mol_type = other DNA
atccacttcatcatcacaaa

SEQ ID NO: 1067 - DNA, 20 bp, synthetic construct
  misc_feature 1..20: note = Synthetic oligonucleotide
  source 1..20: mol_type = other DNA
atttatataataacagaatc

SEQ ID NO: 1068 - DNA, 20 bp, synthetic construct
  misc_feature 1..20: note = Synthetic oligonucleotide
  source 1..20: mol_type = other DNA
gcttaatgcattaatattgc

SEQ ID NO: 1069 - DNA, 20 bp, synthetic construct
  misc_feature 1..20: note = Synthetic oligonucleotide
  source 1..20: mol_type = other DNA
gtttgacattttcagtatta

SEQ ID NO: 1070 - DNA, 20 bp, synthetic construct
  misc_feature 1..20: note = Synthetic oligonucleotide
  source 1..20: mol_type = other DNA
acttcatcatttaagtatta

SEQ ID NO: 1071 - DNA, 20 bp, synthetic construct
  misc_feature 1..20: note = Synthetic oligonucleotide
  source 1..20: mol_type = other DNA
ctacaaaattttaaacactt

SEQ ID NO: 1072 - DNA, 20 bp, synthetic construct
  misc_feature 1..20: note = Synthetic oligonucleotide
  source 1..20: mol_type = other DNA
aacgaaaacactctcagtct

SEQ ID NO: 1073 - DNA, 20 bp, synthetic construct
  misc_feature 1..20: note = Synthetic oligonucleotide
  source 1..20: mol_type = other DNA
aactttgtaaacaataaata

SEQ ID NO: 1074 - DNA, 20 bp, synthetic construct
  misc_feature 1..20: note = Synthetic oligonucleotide
  source 1..20: mol_type = other DNA
aactgtctaccatcttcctt

SEQ ID NO: 1075 - DNA, 20 bp, synthetic construct
  misc_feature 1..20: note = Synthetic oligonucleotide
  source 1..20: mol_type = other DNA
ttgcatacacttaaagctca

SEQ ID NO: 1076 - DNA, 20 bp, synthetic construct
  misc_feature 1..20: note = Synthetic oligonucleotide
  source 1..20: mol_type = other DNA
acctaacctataacttatcc

SEQ ID NO: 1077 - DNA, 20 bp, synthetic construct
  misc_feature 1..20: note = Synthetic oligonucleotide
  source 1..20: mol_type = other DNA
atcttaacaatattttcctc

SEQ ID NO: 1078 - DNA, 20 bp, synthetic construct
  misc_feature 1..20: note = Synthetic oligonucleotide
  source 1..20: mol_type = other DNA
gctttgttcacttaatataa

SEQ ID NO: 1079 - DNA, 20 bp, synthetic construct
  misc_feature 1..20: note = Synthetic oligonucleotide
  source 1..20: mol_type = other DNA
atttacaatttatttatgca

SEQ ID NO: 1080 - DNA, 20 bp, synthetic construct
  misc_feature 1..20: note = Synthetic oligonucleotide
  source 1..20: mol_type = other DNA
acgaaattttttaaacaatt

SEQ ID NO: 1081 - DNA, 20 bp, synthetic construct
  misc_feature 1..20: note = Synthetic oligonucleotide
  source 1..20: mol_type = other DNA
ggctatattttaaacatata

SEQ ID NO: 1082 - DNA, 20 bp, synthetic construct
  misc_feature 1..20: note = Synthetic oligonucleotide
  source 1..20: mol_type = other DNA
ttttcataaattaaattcta

SEQ ID NO: 1083 - DNA, 20 bp, synthetic construct
  misc_feature 1..20: note = Synthetic oligonucleotide
  source 1..20: mol_type = other DNA
gctactataattatacaata

SEQ ID NO: 1084 - DNA, 20 bp, synthetic construct
  misc_feature 1..20: note = Synthetic oligonucleotide
  source 1..20: mol_type = other DNA
attgactttttttactatta

SEQ ID NO: 1085 - DNA, 20 bp, synthetic construct
  misc_feature 1..20: note = Synthetic oligonucleotide
  source 1..20: mol_type = other DNA
acaaaataattaacatttct

SEQ ID NO: 1086 - DNA, 20 bp, synthetic construct
  misc_feature 1..20: note = Synthetic oligonucleotide
  source 1..20: mol_type = other DNA
cactaactactaacacttcc

SEQ ID NO: 1087 - DNA, 20 bp, synthetic construct
  misc_feature 1..20: note = Synthetic oligonucleotide
  source 1..20: mol_type = other DNA
tgaggatccatattcagggt

SEQ ID NO: 1088 - DNA, 20 bp, synthetic construct
  misc_feature 1..20: note = Synthetic oligonucleotide
  source 1..20: mol_type = other DNA
agacatttaaataaatagga

SEQ ID NO: 1089 - DNA, 20 bp, synthetic construct
  misc_feature 1..20: note = Synthetic oligonucleotide
  source 1..20: mol_type = other DNA
atcattttcattatattaat

SEQ ID NO: 1090 - DNA, 20 bp, synthetic construct
  misc_feature 1..20: note = Synthetic oligonucleotide
  source 1..20: mol_type = other DNA
ctgcatgtaacctttataca

SEQ ID NO: 1091 - DNA, 20 bp, synthetic construct
  misc_feature 1..20: note = Synthetic oligonucleotide
  source 1..20: mol_type = other DNA
tttcaaaaaatcatacaaac

SEQ ID NO: 1092 - DNA, 20 bp, synthetic construct
  misc_feature 1..20: note = Synthetic oligonucleotide
  source 1..20: mol_type = other DNA
cttttttcccaaaattataa

SEQ ID NO: 1093 - DNA, 20 bp, synthetic construct
  misc_feature 1..20: note = Synthetic oligonucleotide
  source 1..20: mol_type = other DNA
aacccagttttttcattgca

SEQ ID NO: 1094 - DNA, 20 bp, synthetic construct
  misc_feature 1..20: note = Synthetic oligonucleotide
  source 1..20: mol_type = other DNA
ctactactcactaattcaaa

SEQ ID NO: 1095 - DNA, 20 bp, synthetic construct
  misc_feature 1..20: note = Synthetic oligonucleotide
  source 1..20: mol_type = other DNA
gttcttttcatatattactc

SEQ ID NO: 1096 - DNA, 20 bp, synthetic construct
  misc_feature 1..20: note = Synthetic oligonucleotide
  source 1..20: mol_type = other DNA
tcagaatttttactggagta

SEQ ID NO: 1097 - DNA, 20 bp, synthetic construct
  misc_feature 1..20: note = Synthetic oligonucleotide
  source 1..20: mol_type = other DNA
gctttgggccattttcatca

SEQ ID NO: 1098 - DNA, 20 bp, synthetic construct
  misc_feature 1..20: note = Synthetic oligonucleotide
  source 1..20: mol_type = other DNA
gaacaactgcaatcctatta

SEQ ID NO: 1099 - DNA, 20 bp, synthetic construct
  misc_feature 1..20: note = Synthetic oligonucleotide
  source 1..20: mol_type = other DNA
tttttcagctctttttcact

SEQ ID NO: 1100 - DNA, 20 bp, synthetic construct
  misc_feature 1..20: note = Synthetic oligonucleotide
  source 1..20: mol_type = other DNA
actggctatactcattgctc

SEQ ID NO: 1101 - DNA, 20 bp, synthetic construct
  misc_feature 1..20: note = Synthetic oligonucleotide
  source 1..20: mol_type = other DNA
aagttccattaaactaaggc

SEQ ID NO: 1102 - DNA, 20 bp, synthetic construct
  misc_feature 1..20: note = Synthetic oligonucleotide
  source 1..20: mol_type = other DNA
gcttatctgacaacacttga

SEQ ID NO: 1103 - DNA, 20 bp, synthetic construct
  misc_feature 1..20: note = Synthetic oligonucleotide
  source 1..20: mol_type = other DNA
acacttgaaaaccatatgca

SEQ ID NO: 1104 - DNA, 20 bp, synthetic construct
  misc_feature 1..20: note = Synthetic oligonucleotide
  source 1..20: mol_type = other DNA
tttgtggtttctttgaaccc

SEQ ID NO: 1105 - DNA, 20 bp, synthetic construct
  misc_feature 1..20: note = Synthetic oligonucleotide
  source 1..20: mol_type = other DNA
actttttactttccctgata

SEQ ID NO: 1106 - DNA, 20 bp, synthetic construct
  misc_feature 1..20: note = Synthetic oligonucleotide
  source 1..20: mol_type = other DNA
atgtaaaaataaaacaactc

SEQ ID NO: 1107 - DNA, 20 bp, synthetic construct
  misc_feature 1..20: note = Synthetic oligonucleotide
  source 1..20: mol_type = other DNA
gatggctaaacaatactgca

SEQ ID NO: 1108 - DNA, 20 bp, synthetic construct
  misc_feature 1..20: note = Synthetic oligonucleotide
  source 1..20: mol_type = other DNA
gtgcttaaatcatcattttt

SEQ ID NO: 1109 - DNA, 20 bp, synthetic construct
  misc_feature 1..20: note = Synthetic oligonucleotide
  source 1..20: mol_type = other DNA
ggcaagataaacatgcagca

SEQ ID NO: 1110 - DNA, 20 bp, synthetic construct
  misc_feature 1..20: note = Synthetic oligonucleotide
  source 1..20: mol_type = other DNA
tacttttaatttctcatttt

SEQ ID NO: 1111 - DNA, 20 bp, synthetic construct
  misc_feature 1..20: note = Synthetic oligonucleotide
  source 1..20: mol_type = other DNA
tttctttaagcctctttcaa

SEQ ID NO: 1112 - DNA, 20 bp, synthetic construct
  misc_feature 1..20: note = Synthetic oligonucleotide
  source 1..20: mol_type = other DNA
acactacaagtcaatagctt

SEQ ID NO: 1113 - DNA, 20 bp, synthetic construct
  misc_feature 1..20: note = Synthetic oligonucleotide
  source 1..20: mol_type = other DNA
aatggcatttcaaagataga

SEQ ID NO: 1114 - DNA, 20 bp, synthetic construct
  misc_feature 1..20: note = Synthetic oligonucleotide
  source 1..20: mol_type = other DNA
acactcttcttaattaactt

SEQ ID NO: 1115 - DNA, 20 bp, synthetic construct
  misc_feature 1..20: note = Synthetic oligonucleotide
  source 1..20: mol_type = other DNA
taggaagattttaaattgca

SEQ ID NO: 1116 - DNA, 20 bp, synthetic construct
  misc_feature 1..20: note = Synthetic oligonucleotide
  source 1..20: mol_type = other DNA
ttgttccccattaatgttta

SEQ ID NO: 1117 - DNA, 20 bp, synthetic construct
  misc_feature 1..20: note = Synthetic oligonucleotide
  source 1..20: mol_type = other DNA
ttttaactttctaacactta

SEQ ID NO: 1118 - DNA, 20 bp, synthetic construct
  misc_feature 1..20: note = Synthetic oligonucleotide
  source 1..20: mol_type = other DNA
attactttcacatctaagct

SEQ ID NO: 1119 - DNA, 20 bp, synthetic construct
  misc_feature 1..20: note = Synthetic oligonucleotide
  source 1..20: mol_type = other DNA
tagagccatattttaataat

SEQ ID NO: 1120 - DNA, 20 bp, synthetic construct
  misc_feature 1..20: note = Synthetic oligonucleotide
  source 1..20: mol_type = other DNA
ctattcttttcaaaatatta

SEQ ID NO: 1121 - DNA, 20 bp, synthetic construct
  misc_feature 1..20: note = Synthetic oligonucleotide
  source 1..20: mol_type = other DNA
gttaataatccaatatttta

SEQ ID NO: 1122 - DNA, 20 bp, synthetic construct
  misc_feature 1..20: note = Synthetic oligonucleotide
  source 1..20: mol_type = other DNA
attgataaaatctctaacaa

SEQ ID NO: 1123 - DNA, 20 bp, synthetic construct
  misc_feature 1..20: note = Synthetic oligonucleotide
  source 1..20: mol_type = other DNA
ggcactataaccaatgcaaa

SEQ ID NO: 1124 - DNA, 20 bp, synthetic construct
  misc_feature 1..20: note = Synthetic oligonucleotide
  source 1..20: mol_type = other DNA
atttactttttaacaattat

SEQ ID NO: 1125 - DNA, 20 bp, synthetic construct
  misc_feature 1..20: note = Synthetic oligonucleotide
  source 1..20: mol_type = other DNA
acctcctctaccattagcac

SEQ ID NO: 1126 - DNA, 20 bp, synthetic construct
  misc_feature 1..20: note = Synthetic oligonucleotide
  source 1..20: mol_type = other DNA
acatctaactttcctaggaa

SEQ ID NO: 1127 - DNA, 20 bp, synthetic construct
  misc_feature 1..20: note = Synthetic oligonucleotide
  source 1..20: mol_type = other DNA
accatttattccttatagca

SEQ ID NO: 1128 - DNA, 20 bp, synthetic construct
  misc_feature 1..20: note = Synthetic oligonucleotide
  source 1..20: mol_type = other DNA
ttgtccttccttaattcccg

SEQ ID NO: 1129 - DNA, 20 bp, synthetic construct
  misc_feature 1..20: note = Synthetic oligonucleotide
  source 1..20: mol_type = other DNA
tccataccttatctaattca

SEQ ID NO: 1130 - DNA, 20 bp, synthetic construct
  misc_feature 1..20: note = Synthetic oligonucleotide
  source 1..20: mol_type = other DNA
acctgcatctcctcaggcct

SEQ ID NO: 1131 - DNA, 20 bp, synthetic construct
  misc_feature 1..20: note = Synthetic oligonucleotide
  source 1..20: mol_type = other DNA
tttatttaaatatcaaataa

SEQ ID NO: 1132 - DNA, 20 bp, synthetic construct
  misc_feature 1..20: note = Synthetic oligonucleotide
  source 1..20: mol_type = other DNA
tgagagtttcctttttgcta

SEQ ID NO: 1133 - DNA, 20 bp, synthetic construct
  misc_feature 1..20: note = Synthetic oligonucleotide
  source 1..20: mol_type = other DNA
gtacatttttcaaaagaaca

SEQ ID NO: 1134 - DNA, 20 bp, synthetic construct
  misc_feature 1..20: note = Synthetic oligonucleotide
  source 1..20: mol_type = other DNA
tttatgacacttaaaaactt

SEQ ID NO: 1135 - DNA, 20 bp, synthetic construct
  misc_feature 1..20: note = Synthetic oligonucleotide
  source 1..20: mol_type = other DNA
tctaatagtccatctagatt

SEQ ID NO: 1136 - DNA, 20 bp, synthetic construct
  misc_feature 1..20: note = Synthetic oligonucleotide
  source 1..20: mol_type = other DNA
atctatcatatattcagcct

SEQ ID NO: 1137 - DNA, 20 bp, synthetic construct
  misc_feature 1..20: note = Synthetic oligonucleotide
  source 1..20: mol_type = other DNA
aatgactttcatatttaata

SEQ ID NO: 1138 - DNA, 20 bp, synthetic construct
  misc_feature 1..20: note = Synthetic oligonucleotide
  source 1..20: mol_type = other DNA
ccatgaagtttaaaacttta

SEQ ID NO: 1139 - DNA, 20 bp, synthetic construct
  misc_feature 1..20: note = Synthetic oligonucleotide
  source 1..20: mol_type = other DNA
ttgtcatcaatcataatctc

SEQ ID NO: 1140 - DNA, 20 bp, synthetic construct
  misc_feature 1..20: note = Synthetic oligonucleotide
  source 1..20: mol_type = other DNA
attactttcaacatgagtat

SEQ ID NO: 1141 - DNA, 20 bp, synthetic construct
  misc_feature 1..20: note = Synthetic oligonucleotide
  source 1..20: mol_type = other DNA
ttcattgcaaatataagctc

SEQ ID NO: 1142 - DNA, 20 bp, synthetic construct
  misc_feature 1..20: note = Synthetic oligonucleotide
  source 1..20: mol_type = other DNA
atttattaatccacttcatc

SEQ ID NO: 1143 - DNA, 20 bp, synthetic construct
  misc_feature 1..20: note = Synthetic oligonucleotide
  source 1..20: mol_type = other DNA
atttctctcaccttacccag

SEQ ID NO: 1144 - DNA, 20 bp, synthetic construct
  misc_feature 1..20: note = Synthetic oligonucleotide
  source 1..20: mol_type = other DNA
gatattaactaaattagaac

SEQ ID NO: 1145 - DNA, 20 bp, synthetic construct
  misc_feature 1..20: note = Synthetic oligonucleotide
  source 1..20: mol_type = other DNA
acaataattcctaatatttt

SEQ ID NO: 1146 - DNA, 20 bp, synthetic construct
  misc_feature 1..20: note = Synthetic oligonucleotide
  source 1..20: mol_type = other DNA
cctgatgcaaatcttaccat

SEQ ID NO: 1147 - DNA, 20 bp, synthetic construct
  misc_feature 1..20: note = Synthetic oligonucleotide
  source 1..20: mol_type = other DNA
gtaggactacaaaattttaa

SEQ ID NO: 1148 - DNA, 20 bp, synthetic construct
  misc_feature 1..20: note = Synthetic oligonucleotide
  source 1..20: mol_type = other DNA
ctgcagataataaaacgaaa

SEQ ID NO: 1149 - DNA, 20 bp, synthetic construct
  misc_feature 1..20: note = Synthetic oligonucleotide
  source 1..20: mol_type = other DNA
ccttaatacataactttgta

SEQ ID NO: 1150 - DNA, 20 bp, synthetic construct
  misc_feature 1..20: note = Synthetic oligonucleotide
  source 1..20: mol_type = other DNA
caagaagaatttcaaccaaa

SEQ ID NO: 1151 - DNA, 20 bp, synthetic construct
  misc_feature 1..20: note = Synthetic oligonucleotide
  source 1..20: mol_type = other DNA
ttccaagattctattggcaa

SEQ ID NO: 1152 - DNA, 20 bp, synthetic construct
  misc_feature 1..20: note = Synthetic oligonucleotide
  source 1..20: mol_type = other DNA
atgacctaacctataactta

SEQ ID NO: 1153 - DNA, 20 bp, synthetic construct
  misc_feature 1..20: note = Synthetic oligonucleotide
  source 1..20: mol_type = other DNA
cactttctgcaaaataggta

SEQ ID NO: 1154 - DNA, 20 bp, synthetic construct
  misc_feature 1..20: note = Synthetic oligonucleotide
  source 1..20: mol_type = other DNA
ttgttgctcccatttaccct

SEQ ID NO: 1155 - DNA, 20 bp, synthetic construct
  misc_feature 1..20: note = Synthetic oligonucleotide
  source 1..20: mol_type = other DNA
gtttttttttcctttagttc

SEQ ID NO: 1156 - DNA, 20 bp, synthetic construct
  misc_feature 1..20: note = Synthetic oligonucleotide
  source 1..20: mol_type = other DNA
actttgtttccctttatcta

SEQ ID NO: 1157 - DNA, 20 bp, synthetic construct
  misc_feature 1..20: note = Synthetic oligonucleotide
  source 1..20: mol_type = other DNA
agattgttttaatctagcta

SEQ ID NO: 1158 - DNA, 20 bp, synthetic construct
  misc_feature 1..20: note = Synthetic oligonucleotide
  source 1..20: mol_type = other DNA
gtcagccttttcataaatta

SEQ ID NO: 1159 - DNA, 20 bp, synthetic construct
  misc_feature 1..20: note = Synthetic oligonucleotide
  source 1..20: mol_type = other DNA
gtcccaatttttattaagac

SEQ ID NO: 1160 - DNA, 20 bp, synthetic construct
  misc_feature 1..20: note = Synthetic oligonucleotide
  source 1..20: mol_type = other DNA
cttagtttatatgacagcct

SEQ ID NO: 1161 - DNA, 20 bp, synthetic construct
  misc_feature 1..20: note = Synthetic oligonucleotide
  source 1..20: mol_type = other DNA
agtgacaaaataattaacat

SEQ ID NO: 1162 - DNA, 20 bp, synthetic construct
  misc_feature 1..20: note = Synthetic oligonucleotide
  source 1..20: mol_type = other DNA
caaccactaactactaacac

SEQ ID NO: 1163 - DNA, 20 bp, synthetic construct
  misc_feature 1..20: note = Synthetic oligonucleotide
  source 1..20: mol_type = other DNA
ttctcattttaatatatcta

SEQ ID NO: 1164 - DNA, 20 bp, synthetic construct
  misc_feature 1..20: note = Synthetic oligonucleotide
  source 1..20: mol_type = other DNA
gtatagatgattactagata

SEQ ID NO: 1165 - DNA, 20 bp, synthetic construct
  misc_feature 1..20: note = Synthetic oligonucleotide
  source 1..20: mol_type = other DNA
atatcattttcattatatta

SEQ ID NO: 1166 - DNA, 20 bp, synthetic construct
  misc_feature 1..20: note = Synthetic oligonucleotide
  source 1..20: mol_type = other DNA
atgcataatcccattataca

SEQ ID NO: 1167 - DNA, 20 bp, synthetic construct
  misc_feature 1..20: note = Synthetic oligonucleotide
  source 1..20: mol_type = other DNA
acatcactttcaaaaaatca

SEQ ID NO: 1168 - DNA, 20 bp, synthetic construct
  misc_feature 1..20: note = Synthetic oligonucleotide
  source 1..20: mol_type = other DNA
tcttttttcccaaaattata

SEQ ID NO: 1169 - DNA, 20 bp, synthetic construct
  misc_feature 1..20: note = Synthetic oligonucleotide
  source 1..20: mol_type = other DNA
gaacccagttttttcattgc

SEQ ID NO: 1170 - DNA, 20 bp, synthetic construct
  misc_feature 1..20: note = Synthetic oligonucleotide
  source 1..20: mol_type = other DNA
tgtctactactcactaattc

SEQ ID NO: 1171 - DNA, 20 bp, synthetic construct
  misc_feature 1..20: note = Synthetic oligonucleotide
  source 1..20: mol_type = other DNA
atgttcttttcatatattac

SEQ ID NO: 1172 - DNA, 20 bp, synthetic construct
  misc_feature 1..20: note = Synthetic oligonucleotide
  source 1..20: mol_type = other DNA
ttggagagctgaggtaactt

SEQ ID NO: 1173 - DNA, 20 bp, synthetic construct
  misc_feature 1..20: note = Synthetic oligonucleotide
  source 1..20: mol_type = other DNA
ttcagaatttttactggagt

SEQ ID NO: 1174 - DNA, 20 bp, synthetic construct
  misc_feature 1..20: note = Synthetic oligonucleotide
  source 1..20: mol_type = other DNA
attttcctgcttccaagtca

SEQ ID NO: 1175 - DNA, 20 bp, synthetic construct
  misc_feature 1..20: note = Synthetic oligonucleotide
  source 1..20: mol_type = other DNA
ccattgcaaacatttatttc

SEQ ID NO: 1176 - DNA, 20 bp, synthetic construct
  misc_feature 1..20: note = Synthetic oligonucleotide
  source 1..20: mol_type = other DNA
tcttctgtttttcagctctt

SEQ ID NO: 1177 - DNA, 20 bp, synthetic construct
  misc_feature 1..20: note = Synthetic oligonucleotide
  source 1..20: mol_type = other DNA
atactggctatactcattgc

SEQ ID NO: 1178 - DNA, 20 bp, synthetic construct
  misc_feature 1..20: note = Synthetic oligonucleotide
  source 1..20: mol_type = other DNA
aaccaagttccattaaacta

SEQ ID NO: 1179 - DNA, 20 bp, synthetic construct
  misc_feature 1..20: note = Synthetic oligonucleotide
  source 1..20: mol_type = other DNA
ttctatgcttatctgacaac

SEQ ID NO: 1180 - DNA, 20 bp, synthetic construct
  misc_feature 1..20: note = Synthetic oligonucleotide
  source 1..20: mol_type = other DNA
gacaaagctctcagtggcct

SEQ ID NO: 1181 - DNA, 20 bp, synthetic construct
  misc_feature 1..20: note = Synthetic oligonucleotide
  source 1..20: mol_type = other DNA
ggttacaaaatcaaagacca

SEQ ID NO: 1182 - DNA, 20 bp, synthetic construct
  misc_feature 1..20: note = Synthetic oligonucleotide
  source 1..20: mol_type = other DNA
tactttttactttccctgat

SEQ ID NO: 1183 - DNA, 20 bp, synthetic construct
  misc_feature 1..20: note = Synthetic oligonucleotide
  source 1..20: mol_type = other DNA
gttatgtaaaaataaaacaa

SEQ ID NO: 1184 - DNA, 20 bp, synthetic construct
  misc_feature 1..20: note = Synthetic oligonucleotide
  source 1..20: mol_type = other DNA
agatggctaaacaatactgc

SEQ ID NO: 1185 - DNA, 20 bp, synthetic construct
  misc_feature 1..20: note = Synthetic oligonucleotide
  source 1..20: mol_type = other DNA
tgtgcttaaatcatcatttt

SEQ ID NO: 1186 - DNA, 20 bp, synthetic construct
  misc_feature 1..20: note = Synthetic oligonucleotide
  source 1..20: mol_type = other DNA
ttagacttctgaacagtgga

SEQ ID NO: 1187 - DNA, 20 bp, synthetic construct
  misc_feature 1..20: note = Synthetic oligonucleotide
  source 1..20: mol_type = other DNA
atacttttaatttctcattt

SEQ ID NO: 1188 - DNA, 20 bp, synthetic construct
  misc_feature 1..20: note = Synthetic oligonucleotide
  source 1..20: mol_type = other DNA
gactgatgattactgaataa

SEQ ID NO: 1189 - DNA, 20 bp, synthetic construct
  misc_feature 1..20: note = Synthetic oligonucleotide
  source 1..20: mol_type = other DNA
accaacacactacaagtcaa

SEQ ID NO: 1190 - DNA, 20 bp, synthetic construct
  misc_feature 1..20: note = Synthetic oligonucleotide
  source 1..20: mol_type = other DNA
ttaaatggcatttcaaagat

SEQ ID NO: 1191 - DNA, 20 bp, synthetic construct
  misc_feature 1..20: note = Synthetic oligonucleotide
  source 1..20: mol_type = other DNA
tacactcttcttaattaact

SEQ ID NO: 1192 - DNA, 20 bp, synthetic construct
  misc_feature 1..20: note = Synthetic oligonucleotide
  source 1..20: mol_type = other DNA
atctgcttcattatatctct

SEQ ID NO: 1193 - DNA, 20 bp, synthetic construct
  misc_feature 1..20: note = Synthetic oligonucleotide
  source 1..20: mol_type = other DNA
ttttgatattcaatttacct

SEQ ID NO: 1194 - DNA, 20 bp, synthetic construct
  misc_feature 1..20: note = Synthetic oligonucleotide
  source 1..20: mol_type = other DNA
acattttaactttctaacac

SEQ ID NO: 1195 - DNA, 20 bp, synthetic construct
  misc_feature 1..20: note = Synthetic oligonucleotide
  source 1..20: mol_type = other DNA
agcatattaattactttcac

SEQ ID NO: 1196 - DNA, 20 bp, synthetic construct
  misc_feature 1..20: note = Synthetic oligonucleotide
  source 1..20: mol_type = other DNA
atagagccatattttaataa

SEQ ID NO: 1197 - DNA, 20 bp, synthetic construct
  misc_feature 1..20: note = Synthetic oligonucleotide
  source 1..20: mol_type = other DNA
ctttagagataatctagtcc

SEQ ID NO: 1198 - DNA, 20 bp, synthetic construct
  misc_feature 1..20: note = Synthetic oligonucleotide
  source 1..20: mol_type = other DNA
gcttaagaacacattagtga

SEQ ID NO: 1199 - DNA, 20 bp, synthetic construct
  misc_feature 1..20: note = Synthetic oligonucleotide
  source 1..20: mol_type = other DNA
atgttgtattctaattatca

SEQ ID NO: 1200 - DNA, 20 bp, synthetic construct
  misc_feature 1..20: note = Synthetic oligonucleotide
  source 1..20: mol_type = other DNA
aattaaatccctactttata

SEQ ID NO: 1201 - DNA, 20 bp, synthetic construct
  misc_feature 1..20: note = Synthetic oligonucleotide
  source 1..20: mol_type = other DNA
aatttactttttaacaatta

SEQ ID NO: 1202 - DNA, 20 bp, synthetic construct
  misc_feature 1..20: note = Synthetic oligonucleotide
  source 1..20: mol_type = other DNA
tctcacctcctctaccatta

SEQ ID NO: 1203 - DNA, 20 bp, synthetic construct
  misc_feature 1..20: note = Synthetic oligonucleotide
  source 1..20: mol_type = other DNA
tgcttttctttaacagaaat

SEQ ID NO: 1204 - DNA, 20 bp, synthetic construct
  misc_feature 1..20: note = Synthetic oligonucleotide
  source 1..20: mol_type = other DNA
aagcactattttaagagcta

SEQ ID NO: 1205 - DNA, 20 bp, synthetic construct
  misc_feature 1..20: note = Synthetic oligonucleotide
  source 1..20: mol_type = other DNA
ttttgtccttccttaattcc

SEQ ID NO: 1206 - DNA, 20 bp, synthetic construct
  misc_feature 1..20: note = Synthetic oligonucleotide
  source 1..20: mol_type = other DNA
gaaacataaacatcaaataa

SEQ ID NO: 1207 - DNA, 20 bp, synthetic construct
  misc_feature 1..20: note = Synthetic oligonucleotide
  source 1..20: mol_type = other DNA
cttcacatttcaacctgcat

SEQ ID NO: 1208 - DNA, 20 bp, synthetic construct
  misc_feature 1..20: note = Synthetic oligonucleotide
  source 1..20: mol_type = other DNA
atgttttatttaaatatcaa

SEQ ID NO: 1209 - DNA, 20 bp, synthetic construct
  misc_feature 1..20: note = Synthetic oligonucleotide
  source 1..20: mol_type = other DNA
ggacactatttaatgaatca

SEQ ID NO: 1210 - DNA, 20 bp, synthetic construct
  misc_feature 1..20: note = Synthetic oligonucleotide
  source 1..20: mol_type = other DNA
ttaatttatttcatcagtca

SEQ ID NO: 1211 - DNA, 20 bp, synthetic construct
  misc_feature 1..20: note = Synthetic oligonucleotide
  source 1..20: mol_type = other DNA
attttgcaattcatttgtta

SEQ ID NO: 1212 - DNA, 20 bp, synthetic construct
  misc_feature 1..20: note = Synthetic oligonucleotide
  source 1..20: mol_type = other DNA
agcatcaaatctaatagtcc

SEQ ID NO: 1213 - DNA, 20 bp, synthetic construct
  misc_feature 1..20: note = Synthetic oligonucleotide
  source 1..20: mol_type = other DNA
gcttatctttccttttctta

SEQ ID NO: 1214 - DNA, 20 bp, synthetic construct
  misc_feature 1..20: note = Synthetic oligonucleotide
  source 1..20: mol_type = other DNA
gtaatgactttcatatttaa

SEQ ID NO: 1215 - DNA, 20 bp, synthetic construct
  misc_feature 1..20: note = Synthetic oligonucleotide
  source 1..20: mol_type = other DNA
gccttcaccaccatgaagtt

SEQ ID NO: 1216 - DNA, 20 bp, synthetic construct
  misc_feature 1..20: note = Synthetic oligonucleotide
  source 1..20: mol_type = other DNA
ggcattgtcatcaatcataa

SEQ ID NO: 1217 - DNA, 20 bp, synthetic construct
  misc_feature 1..20: note = Synthetic oligonucleotide
  source 1..20: mol_type = other DNA
aaacattttttaatatggca

SEQ ID NO: 1218 - DNA, 20 bp, synthetic construct
  misc_feature 1..20: note = Synthetic oligonucleotide
  source 1..20: mol_type = other DNA
ataacattcttatatcagca

SEQ ID NO: 1219 - DNA, 20 bp, synthetic construct
  misc_feature 1..20: note = Synthetic oligonucleotide
  source 1..20: mol_type = other DNA
tatacatttattaatccact

SEQ ID NO: 1220 - DNA, 20 bp, synthetic construct
  misc_feature 1..20: note = Synthetic oligonucleotide
  source 1..20: mol_type = other DNA
atgtctgttttatacaggca

SEQ ID NO: 1221 - DNA, 20 bp, synthetic construct
  misc_feature 1..20: note = Synthetic oligonucleotide
  source 1..20: mol_type = other DNA
cttctcttcacatataaaaa

SEQ ID NO: 1222 - DNA, 20 bp, synthetic construct
  misc_feature 1..20: note = Synthetic oligonucleotide
  source 1..20: mol_type = other DNA
tagtttttcaatacaaacac

SEQ ID NO: 1223 - DNA, 20 bp, synthetic construct
  misc_feature 1..20: note = Synthetic oligonucleotide
  source 1..20: mol_type = other DNA
gcaggacttttaacatacct

SEQ ID NO: 1224 - DNA, 20 bp, synthetic construct
  misc_feature 1..20: note = Synthetic oligonucleotide
  source 1..20: mol_type = other DNA
attcagataaaatctgcaac

SEQ ID NO: 1225 - DNA, 20 bp, synthetic construct
  misc_feature 1..20: note = Synthetic oligonucleotide
  source 1..20: mol_type = other DNA
ttatttctcacaaatacaca

SEQ ID NO: 1226 - DNA, 20 bp, synthetic construct
  misc_feature 1..20: note = Synthetic oligonucleotide
  source 1..20: mol_type = other DNA
ccatttcccttaatacataa

SEQ ID NO: 1227 - DNA, 20 bp, synthetic construct
  misc_feature 1..20: note = Synthetic oligonucleotide
  source 1..20: mol_type = other DNA
tgacataaaattttatatta

SEQ ID NO: 1228 - DNA, 20 bp, synthetic construct
  misc_feature 1..20: note = Synthetic oligonucleotide
  source 1..20: mol_type = other DNA
ttggtttaaattaaaaggaa

SEQ ID NO: 1229 - DNA, 20 bp, synthetic construct
  misc_feature 1..20: note = Synthetic oligonucleotide
  source 1..20: mol_type = other DNA
tatgacctaacctataactt

SEQ ID NO: 1230 - DNA, 20 bp, synthetic construct
  misc_feature 1..20: note = Synthetic oligonucleotide
  source 1..20: mol_type = other DNA
ctttattttttttctagtta

SEQ ID NO: 1231 - DNA, 20 bp, synthetic construct
  misc_feature 1..20: note = Synthetic oligonucleotide
  source 1..20: mol_type = other DNA
aaggtgatatatacaagaac

SEQ ID NO: 1232 - DNA, 20 bp, synthetic construct
  misc_feature 1..20: note = Synthetic oligonucleotide
  source 1..20: mol_type = other DNA
gttaaatttattactatatt

SEQ ID NO: 1233 - DNA, 20 bp, synthetic construct
  misc_feature 1..20: note = Synthetic oligonucleotide
  source 1..20: mol_type = other DNA
gtctctgatctttctagccc

SEQ ID NO: 1234 - DNA, 20 bp, synthetic construct
  misc_feature 1..20: note = Synthetic oligonucleotide
  source 1..20: mol_type = other DNA
atcaacacttaaattacata

SEQ ID NO: 1235 - DNA, 20 bp, synthetic construct
  misc_feature 1..20: note = Synthetic oligonucleotide
  source 1..20: mol_type = other DNA
attctcttttcaacttcaat

SEQ ID NO: 1236 - DNA, 20 bp, synthetic construct
  misc_feature 1..20: note = Synthetic oligonucleotide
  source 1..20: mol_type = other DNA
ccaatatatttaaatatgat

SEQ ID NO: 1237 - DNA, 20 bp, synthetic construct
  misc_feature 1..20: note = Synthetic oligonucleotide
  source 1..20: mol_type = other DNA
gtataattcattcttagttt

SEQ ID NO: 1238 - DNA, 20 bp, synthetic construct
  misc_feature 1..20: note = Synthetic oligonucleotide
  source 1..20: mol_type = other DNA
aagtgacaaaataattaaca

SEQ ID NO: 1239 - DNA, 20 bp, synthetic construct
  misc_feature 1..20: note = Synthetic oligonucleotide
  source 1..20: mol_type = other DNA
atccaaccactaactactaa

SEQ ID NO: 1240 - DNA, 20 bp, synthetic construct
  misc_feature 1..20: note = Synthetic oligonucleotide
  source 1..20: mol_type = other DNA
cttctcattttaatatatct

SEQ ID NO: 1241 - DNA, 20 bp, synthetic construct
  misc_feature 1..20: note = Synthetic oligonucleotide
  source 1..20: mol_type = other DNA
gcattttttttcaaacagca

SEQ ID NO: 1242 - DNA, 20 bp, synthetic construct
  misc_feature 1..20: note = Synthetic oligonucleotide
  source 1..20: mol_type = other DNA
acatttgtatcaccaattaa

SEQ ID NO: 1243 - DNA, 20 bp, synthetic construct
  misc_feature 1..20: note = Synthetic oligonucleotide
  source 1..20: mol_type = other DNA
cttttatcctaacatagata

SEQ ID NO: 1244 - DNA, 20 bp, synthetic construct
  misc_feature 1..20: note = Synthetic oligonucleotide
  source 1..20: mol_type = other DNA
gcaaatttacctcaaaggat

SEQ ID NO: 1245 - DNA, 20 bp, synthetic construct
  misc_feature 1..20: note = Synthetic oligonucleotide
  source 1..20: mol_type = other DNA
aaacaatttccctctaacta

SEQ ID NO: 1246 - DNA, 20 bp, synthetic construct
  misc_feature 1..20: note = Synthetic oligonucleotide
  source 1..20: mol_type = other DNA
ttgaacccagttttttcatt

SEQ ID NO: 1247 - DNA, 20 bp, synthetic construct
  misc_feature 1..20: note = Synthetic oligonucleotide
  source 1..20: mol_type = other DNA
tcttttcacattactaggct

SEQ ID NO: 1248 - DNA, 20 bp, synthetic construct
  misc_feature 1..20: note = Synthetic oligonucleotide
  source 1..20: mol_type = other DNA
agataattccaaacttctca

SEQ ID NO: 1249 - DNA, 20 bp, synthetic construct
  misc_feature 1..20: note = Synthetic oligonucleotide
  source 1..20: mol_type = other DNA
aaaattccttgcaaaaccag

SEQ ID NO: 1250 - DNA, 20 bp, synthetic construct
  misc_feature 1..20: note = Synthetic oligonucleotide
  source 1..20: mol_type = other DNA
caattcttcagaatttttac

SEQ ID NO: 1251 - DNA, 20 bp, synthetic construct
  misc_feature 1..20: note = Synthetic oligonucleotide
  source 1..20: mol_type = other DNA
gaagagattttcctgcttcc

SEQ ID NO: 1252 - DNA, 20 bp, synthetic construct
  misc_feature 1..20: note = Synthetic oligonucleotide
  source 1..20: mol_type = other DNA
gccattgcaaacatttattt

SEQ ID NO: 1253 - DNA, 20 bp, synthetic construct
  misc_feature 1..20: note = Synthetic oligonucleotide
  source 1..20: mol_type = other DNA
tttttctcttcttctccaga

SEQ ID NO: 1254 - DNA, 20 bp, synthetic construct
  misc_feature 1..20: note = Synthetic oligonucleotide
  source 1..20: mol_type = other DNA
gttggtcaaaatactggcta

SEQ ID NO: 1255 - DNA, 20 bp, synthetic construct
  misc_feature 1..20: note = Synthetic oligonucleotide
  source 1..20: mol_type = other DNA
acaatccttccacatttgcc

SEQ ID NO: 1256 - DNA, 20 bp, synthetic construct
  misc_feature 1..20: note = Synthetic oligonucleotide
  source 1..20: mol_type = other DNA
cttctatgcttatctgacaa

SEQ ID NO: 1257 - DNA, 20 bp, synthetic construct
  misc_feature 1..20: note = Synthetic oligonucleotide
  source 1..20: mol_type = other DNA
ggacaaagctctcagtggcc

SEQ ID NO: 1258 - DNA, 20 bp, synthetic construct
  misc_feature 1..20: note = Synthetic oligonucleotide
  source 1..20: mol_type = other DNA
tggttacaaaatcaaagacc

SEQ ID NO: 1259 - DNA, 20 bp, synthetic construct
  misc_feature 1..20: note = Synthetic oligonucleotide
  source 1..20: mol_type = other DNA
tttttactttttactttccc

SEQ ID NO: 1260 - DNA, 20 bp, synthetic construct
  misc_feature 1..20: note = Synthetic oligonucleotide
  source 1..20: mol_type = other DNA
ggttatgtaaaaataaaaca

SEQ ID NO: 1261 - DNA, 20 bp, synthetic construct
  misc_feature 1..20: note = Synthetic oligonucleotide
  source 1..20: mol_type = other DNA
gaagatggctaaacaatact

SEQ ID NO: 1262 - DNA, 20 bp, synthetic construct
  misc_feature 1..20: note = Synthetic oligonucleotide
  source 1..20: mol_type = other DNA
agtgtgcttaaatcatcatt

SEQ ID NO: 1263 - DNA, 20 bp, synthetic construct
  misc_feature 1..20: note = Synthetic oligonucleotide
  source 1..20: mol_type = other DNA
atatggcttcccatattaga

SEQ ID NO: 1264 - DNA, 20 bp, synthetic construct
  misc_feature 1..20: note = Synthetic oligonucleotide
  source 1..20: mol_type = other DNA
aagatacttttaatttctca

SEQ ID NO: 1265 - DNA, 20 bp, synthetic construct
  misc_feature 1..20: note = Synthetic oligonucleotide
  source 1..20: mol_type = other DNA
gtgtaaacaaacattggaaa

SEQ ID NO: 1266 - DNA, 20 bp, synthetic construct
  misc_feature 1..20: note = Synthetic oligonucleotide
  source 1..20: mol_type = other DNA
caccaacacactacaagtca

SEQ ID NO: 1267 - DNA, 20 bp, synthetic construct
  misc_feature 1..20: note = Synthetic oligonucleotide
  source 1..20: mol_type = other DNA
aatctacctttaaatggcat

SEQ ID NO: 1268 - DNA, 20 bp, synthetic construct
  misc_feature 1..20: note = Synthetic oligonucleotide
  source 1..20: mol_type = other DNA
atacactcttcttaattaac

SEQ ID NO: 1269 - DNA, 20 bp, synthetic construct
  misc_feature 1..20: note = Synthetic oligonucleotide
  source 1..20: mol_type = other DNA
gcaccttctataatatcaac

SEQ ID NO: 1270 - DNA, 20 bp, synthetic construct
  misc_feature 1..20: note = Synthetic oligonucleotide
  source 1..20: mol_type = other DNA
tctcatgtccaatttagtcc

SEQ ID NO: 1271 - DNA, 20 bp, synthetic construct
  misc_feature 1..20: note = Synthetic oligonucleotide
  source 1..20: mol_type = other DNA
tttcacattttaactttcta

SEQ ID NO: 1272 - DNA, 20 bp, synthetic construct
  misc_feature 1..20: note = Synthetic oligonucleotide
  source 1..20: mol_type = other DNA
aagatgcttattaatatctt

SEQ ID NO: 1273 - DNA, 20 bp, synthetic construct
  misc_feature 1..20: note = Synthetic oligonucleotide
  source 1..20: mol_type = other DNA
catagagccatattttaata

SEQ ID NO: 1274 - DNA, 20 bp, synthetic construct
  misc_feature 1..20: note = Synthetic oligonucleotide
  source 1..20: mol_type = other DNA
acctagtatataacttccct

SEQ ID NO: 1275 - DNA, 20 bp, synthetic construct
  misc_feature 1..20: note = Synthetic oligonucleotide
  source 1..20: mol_type = other DNA
ctaataatccataaatgtaa

SEQ ID NO: 1276 - DNA, 20 bp, synthetic construct
  misc_feature 1..20: note = Synthetic oligonucleotide
  source 1..20: mol_type = other DNA
tgaagataattaaatgctaa

SEQ ID NO: 1277 - DNA, 20 bp, synthetic construct
  misc_feature 1..20: note = Synthetic oligonucleotide
  source 1..20: mol_type = other DNA
agatttagaattaaatccct

SEQ ID NO: 1278 - DNA, 20 bp, synthetic construct
  misc_feature 1..20: note = Synthetic oligonucleotide
  source 1..20: mol_type = other DNA
gtttctcaatttacttttta

SEQ ID NO: 1279 - DNA, 20 bp, synthetic construct
  misc_feature 1..20: note = Synthetic oligonucleotide
  source 1..20: mol_type = other DNA
tttctcacctcctctaccat

SEQ ID NO: 1280 - DNA, 20 bp, synthetic construct
  misc_feature 1..20: note = Synthetic oligonucleotide
  source 1..20: mol_type = other DNA
tcctaagacacattttgctt

SEQ ID NO: 1281 - DNA, 20 bp, synthetic construct
  misc_feature 1..20: note = Synthetic oligonucleotide
  source 1..20: mol_type = other DNA
ttttaataaaaatctacaca

SEQ ID NO: 1282 - DNA, 20 bp, synthetic construct
  misc_feature 1..20: note = Synthetic oligonucleotide
  source 1..20: mol_type = other DNA
ttttgcttctcaacattatt

SEQ ID NO: 1283 - DNA, 20 bp, synthetic construct
  misc_feature 1..20: note = Synthetic oligonucleotide
  source 1..20: mol_type = other DNA
tgaaacataaacatcaaata

SEQ ID NO: 1284 - DNA, 20 bp, synthetic construct
  misc_feature 1..20: note = Synthetic oligonucleotide
  source 1..20: mol_type = other DNA
ggctggcttcacatttcaac

SEQ ID NO: 1285 - DNA, 20 bp, synthetic construct
  misc_feature 1..20: note = Synthetic oligonucleotide
  source 1..20: mol_type = other DNA
aatcatgttttatttaaata

SEQ ID NO: 1286 - DNA, 20 bp, synthetic construct
  misc_feature 1..20: note = Synthetic oligonucleotide
  source 1..20: mol_type = other DNA
ccatgatattttatatctca

SEQ ID NO: 1287 - DNA, 20 bp, synthetic construct
  misc_feature 1..20: note = Synthetic oligonucleotide
  source 1..20: mol_type = other DNA
aagtttctaaatcattgtta

SEQ ID NO: 1288 - DNA, 20 bp, synthetic construct
  misc_feature 1..20: note = Synthetic oligonucleotide
  source 1..20: mol_type = other DNA
actaatgaaattaattttgc

SEQ ID NO: 1289 - DNA, 20 bp, synthetic construct
  misc_feature 1..20: note = Synthetic oligonucleotide
  source 1..20: mol_type = other DNA
atctaattaaccatcaaata

SEQ ID NO: 1290 - DNA, 20 bp, synthetic construct
  misc_feature 1..20: note = Synthetic oligonucleotide
  source 1..20: mol_type = other DNA
ccttttccatatcatggcca

SEQ ID NO: 1291 - DNA, 20 bp, synthetic construct
  misc_feature 1..20: note = Synthetic oligonucleotide
  source 1..20: mol_type = other DNA
actatttaagaaaatattca

SEQ ID NO: 1292 - DNA, 20 bp, synthetic construct
  misc_feature 1..20: note = Synthetic oligonucleotide
  source 1..20: mol_type = other DNA
accatgccttcaccaccatg

SEQ ID NO: 1293 - DNA, 20 bp, synthetic construct
  misc_feature 1..20: note = Synthetic oligonucleotide
  source 1..20: mol_type = other DNA
cttggtctttcatcaagacc

SEQ ID NO: 1294 - DNA, 20 bp, synthetic construct
  misc_feature 1..20: note = Synthetic oligonucleotide
  source 1..20: mol_type = other DNA
taaacattttttaatatggc

SEQ ID NO: 1295 - DNA, 20 bp, synthetic construct
  misc_feature 1..20: note = Synthetic oligonucleotide
  source 1..20: mol_type = other DNA
tggttagcaaatctatgtta

SEQ ID NO: 1296 - DNA, 20 bp, synthetic construct
  misc_feature 1..20: note = Synthetic oligonucleotide
  source 1..20: mol_type = other DNA
ctatacatttattaatccac

SEQ ID NO: 1297 - DNA, 20 bp, synthetic construct
  misc_feature 1..20: note = Synthetic oligonucleotide
  source 1..20: mol_type = other DNA
cctgttttaatatatgccaa

SEQ ID NO: 1298 - DNA, 20 bp, synthetic construct
  misc_feature 1..20: note = Synthetic oligonucleotide
  source 1..20: mol_type = other DNA
agtaatgaaaataatactat

SEQ ID NO: 1299 - DNA, 20 bp, synthetic construct
  misc_feature 1..20: note = Synthetic oligonucleotide
  source 1..20: mol_type = other DNA
gtatagtttttcaatacaaa

SEQ ID NO: 1300 - DNA, 20 bp, synthetic construct
  misc_feature 1..20: note = Synthetic oligonucleotide
  source 1..20: mol_type = other DNA
tcatcattaccaaagcacca

SEQ ID NO: 1301 - DNA, 20 bp, synthetic construct
  misc_feature 1..20: note = Synthetic oligonucleotide
  source 1..20: mol_type = other DNA
gactgctacacattatgtta

SEQ ID NO: 1302 - DNA, 20 bp, synthetic construct
  misc_feature 1..20: note = Synthetic oligonucleotide
  source 1..20: mol_type = other DNA
attatttctcacaaatacac

SEQ ID NO: 1303 - DNA, 20 bp, synthetic construct
  misc_feature 1..20: note = Synthetic oligonucleotide
  source 1..20: mol_type = other DNA
tccatttcccttaatacata

SEQ ID NO: 1304 - DNA, 20 bp, synthetic construct
  misc_feature 1..20: note = Synthetic oligonucleotide
  source 1..20: mol_type = other DNA
aaacatgacataaaatttta

SEQ ID NO: 1305 - DNA, 20 bp, synthetic construct
  misc_feature 1..20: note = Synthetic oligonucleotide
  source 1..20: mol_type = other DNA
tgcttactttctattaagca

SEQ ID NO: 1306 - DNA, 20 bp, synthetic construct
  misc_feature 1..20: note = Synthetic oligonucleotide
  source 1..20: mol_type = other DNA
ttttatgacctaacctataa

SEQ ID NO: 1307 - DNA, 20 bp, synthetic construct
  misc_feature 1..20: note = Synthetic oligonucleotide
  source 1..20: mol_type = other DNA
gtaagttttaaaatttggaa

SEQ ID NO: 1308 - DNA, 20 bp, synthetic construct
  misc_feature 1..20: note = Synthetic oligonucleotide
  source 1..20: mol_type = other DNA
tgcatatcatctaattttta

SEQ ID NO: 1309 - DNA, 20 bp, synthetic construct
  misc_feature 1..20: note = Synthetic oligonucleotide
  source 1..20: mol_type = other DNA
tttgttaaatttattactat

SEQ ID NO: 1310 - DNA, 20 bp, synthetic construct
  misc_feature 1..20: note = Synthetic oligonucleotide
  source 1..20: mol_type = other DNA
gtcaataaaattaatattat

SEQ ID NO: 1311 - DNA, 20 bp, synthetic construct
  misc_feature 1..20: note = Synthetic oligonucleotide
  source 1..20: mol_type = other DNA
atatcaacacttaaattaca

SEQ ID NO: 1312 - DNA, 20 bp, synthetic construct
  misc_feature 1..20: note = Synthetic oligonucleotide
  source 1..20: mol_type = other DNA
ctgatgtcaaccataagtac

SEQ ID NO: 1313 - DNA, 20 bp, synthetic construct
  misc_feature 1..20: note = Synthetic oligonucleotide
  source 1..20: mol_type = other DNA
ttattcctaaaatcaacaat

SEQ ID NO: 1314 - DNA, 20 bp, synthetic construct
  misc_feature 1..20: note = Synthetic oligonucleotide
  source 1..20: mol_type = other DNA
gtcaagttaaacattcctca

SEQ ID NO: 1315 - DNA, 20 bp, synthetic construct
  misc_feature 1..20: note = Synthetic oligonucleotide
  source 1..20: mol_type = other DNA
ctacacttttatattagtgc

SEQ ID NO: 1316 - DNA, 20 bp, synthetic construct
  misc_feature 1..20: note = Synthetic oligonucleotide
  source 1..20: mol_type = other DNA
tatccaaccactaactacta

SEQ ID NO: 1317 - DNA, 20 bp, synthetic construct
  misc_feature 1..20: note = Synthetic oligonucleotide
  source 1..20: mol_type = other DNA
catgtttttctaatttccta

SEQ ID NO: 1318 - DNA, 20 bp, synthetic construct
  misc_feature 1..20: note = Synthetic oligonucleotide
  source 1..20: mol_type = other DNA
atatctaattacataaatta

SEQ ID NO: 1319 - DNA, 20 bp, synthetic construct
  misc_feature 1..20: note = Synthetic oligonucleotide
  source 1..20: mol_type = other DNA
tagttattaattaaattgaa

SEQ ID NO: 1320 - DNA, 20 bp, synthetic construct
  misc_feature 1..20: note = Synthetic oligonucleotide
  source 1..20: mol_type = other DNA
aagagtttccttatattcaa

SEQ ID NO: 1321 - DNA, 20 bp, synthetic construct
  misc_feature 1..20: note = Synthetic oligonucleotide
  source 1..20: mol_type = other DNA
agcaaatttacctcaaagga

SEQ ID NO: 1322 - DNA, 20 bp, synthetic construct
  misc_feature 1..20: note = Synthetic oligonucleotide
  source 1..20: mol_type = other DNA
gccttgctaaatactagaaa

SEQ ID NO: 1323 - DNA, 20 bp, synthetic construct
  misc_feature 1..20: note = Synthetic oligonucleotide
  source 1..20: mol_type = other DNA
tttgaacccagttttttcat

SEQ ID NO: 1324 - DNA, 20 bp, synthetic construct
  misc_feature 1..20: note = Synthetic oligonucleotide
  source 1..20: mol_type = other DNA
gttaaactctctaaaatctt

SEQ ID NO: 1325 - DNA, 20 bp, synthetic construct
  misc_feature 1..20: note = Synthetic oligonucleotide
  source 1..20: mol_type = other DNA
tctctaacttcatcttggcc

SEQ ID NO: 1326 - DNA, 20 bp, synthetic construct
  misc_feature 1..20: note = Synthetic oligonucleotide
  source 1..20: mol_type = other DNA
aaaaattccttgcaaaacca

SEQ ID NO: 1327 - DNA, 20 bp, synthetic construct
  misc_feature 1..20: note = Synthetic oligonucleotide
  source 1..20: mol_type = other DNA
gcaattcttcagaattttta

SEQ ID NO: 1328 - DNA, 20 bp, synthetic construct
  misc_feature 1..20: note = Synthetic oligonucleotide
  source 1..20: mol_type = other DNA
gctttccctttattcaatac

SEQ ID NO: 1329 - DNA, 20 bp, synthetic construct
  misc_feature 1..20: note = Synthetic oligonucleotide
  source 1..20: mol_type = other DNA
tgatatttatttcaaaggaa

SEQ ID NO: 1330 - DNA, 20 bp, synthetic construct
  misc_feature 1..20: note = Synthetic oligonucleotide
  source 1..20: mol_type = other DNA
catttttctcttcttctcca

SEQ ID NO: 1331 - DNA, 20 bp, synthetic construct
  misc_feature 1..20: note = Synthetic oligonucleotide
  source 1..20: mol_type = other DNA
tgttggtcaaaatactggct

SEQ ID NO: 1332 - DNA, 20 bp, synthetic construct
  misc_feature 1..20: note = Synthetic oligonucleotide
  source 1..20: mol_type = other DNA
gacaatccttccacatttgc

SEQ ID NO: 1333 - DNA, 20 bp, synthetic construct
  misc_feature 1..20: note = Synthetic oligonucleotide
  source 1..20: mol_type = other DNA
ttgccttcttctatgcttat

SEQ ID NO: 1334 - DNA, 20 bp, synthetic construct
  misc_feature 1..20: note = Synthetic oligonucleotide
  source 1..20: mol_type = other DNA
tgatactgaatattagccaa

SEQ ID NO: 1335 - DNA, 20 bp, synthetic construct
  misc_feature 1..20: note = Synthetic oligonucleotide
  source 1..20: mol_type = other DNA
gtttgtcatttcttgactct

SEQ ID NO: 1336 - DNA, 20 bp, synthetic construct
  misc_feature 1..20: note = Synthetic oligonucleotide
  source 1..20: mol_type = other DNA
tttctttttactttttactt

SEQ ID NO: 1337 - DNA, 20 bp, synthetic construct
  misc_feature 1..20: note = Synthetic oligonucleotide
  source 1..20: mol_type = other DNA
catgtacatttaatgggtta

SEQ ID NO: 1338 - DNA, 20 bp, synthetic construct
  misc_feature 1..20: note = Synthetic oligonucleotide
  source 1..20: mol_type = other DNA
tgtcaaccttaccaagagca

SEQ ID NO: 1339 - DNA, 20 bp, synthetic construct
  misc_feature 1..20: note = Synthetic oligonucleotide
  source 1..20: mol_type = other DNA
gtagtgtgcttaaatcatca

SEQ ID NO: 1340 - DNA, 20 bp, synthetic construct
  misc_feature 1..20: note = Synthetic oligonucleotide
  source 1..20: mol_type = other DNA
atatatggcttcccatatta

SEQ ID NO: 1341 - DNA, 20 bp, synthetic construct
  misc_feature 1..20: note = Synthetic oligonucleotide
  source 1..20: mol_type = other DNA
gaagatacttttaatttctc

SEQ ID NO: 1342 - DNA, 20 bp, synthetic construct
  misc_feature 1..20: note = Synthetic oligonucleotide
  source 1..20: mol_type = other DNA
ctgtgtaaacaaacattgga

SEQ ID NO: 1343 - DNA, 20 bp, synthetic construct
  misc_feature 1..20: note = Synthetic oligonucleotide
  source 1..20: mol_type = other DNA
tcaccaacacactacaagtc

SEQ ID NO: 1344 - DNA, 20 bp, synthetic construct
  misc_feature 1..20: note = Synthetic oligonucleotide
  source 1..20: mol_type = other DNA
aaatctacctttaaatggca

SEQ ID NO: 1345 - DNA, 20 bp, synthetic construct
  misc_feature 1..20: note = Synthetic oligonucleotide
  source 1..20: mol_type = other DNA
aatacactcttcttaattaa

SEQ ID NO: 1346 - DNA, 20 bp, synthetic construct
  misc_feature 1..20: note = Synthetic oligonucleotide
  source 1..20: mol_type = other DNA
agcaccttctataatatcaa

SEQ ID NO: 1347 - DNA, 20 bp, synthetic construct
  misc_feature 1..20: note = Synthetic oligonucleotide
  source 1..20: mol_type = other DNA
tatctctcctacctttccct

SEQ ID NO: 1348 - DNA, 20 bp, synthetic construct
  misc_feature 1..20: note = Synthetic oligonucleotide
  source 1..20: mol_type = other DNA
gcataatttactaacagttt

SEQ ID NO: 1349 - DNA, 20 bp, synthetic construct
  misc_feature 1..20: note = Synthetic oligonucleotide
  source 1..20: mol_type = other DNA
atactttttccaaagtatta

SEQ ID NO: 1350 - DNA, 20 bp, synthetic construct
  misc_feature 1..20: note = Synthetic oligonucleotide
  source 1..20: mol_type = other DNA
ccatagagccatattttaat

SEQ ID NO: 1351 - DNA, 20 bp, synthetic construct
  misc_feature 1..20: note = Synthetic oligonucleotide
  source 1..20: mol_type = other DNA
aggtgattcaccttatttta

SEQ ID NO: 1352 - DNA, 20 bp, synthetic construct
  misc_feature 1..20: note = Synthetic oligonucleotide
  source 1..20: mol_type = other DNA
ttctttttccatttgaataa

SEQ ID NO: 1353 - DNA, 20 bp, synthetic construct
  misc_feature 1..20: note = Synthetic oligonucleotide
  source 1..20: mol_type = other DNA
ctgaagataattaaatgcta

SEQ ID NO: 1354 - DNA, 20 bp, synthetic construct
  misc_feature 1..20: note = Synthetic oligonucleotide
  source 1..20: mol_type = other DNA
gaaaatatttttcaacatta

SEQ ID NO: 1355 - DNA, 20 bp, synthetic construct
  misc_feature 1..20: note = Synthetic oligonucleotide
  source 1..20: mol_type = other DNA
tattgtttctcaatttactt

SEQ ID NO: 1356 - DNA, 20 bp, synthetic construct
  misc_feature 1..20: note = Synthetic oligonucleotide
  source 1..20: mol_type = other DNA
tcatttctcacctcctctac

SEQ ID NO: 1357 - DNA, 20 bp, synthetic construct
  misc_feature 1..20: note = Synthetic oligonucleotide
  source 1..20: mol_type = other DNA
agatattccattaaatgatt

SEQ ID NO: 1358 - DNA, 20 bp, synthetic construct
  misc_feature 1..20: note = Synthetic oligonucleotide
  source 1..20: mol_type = other DNA
ctttttttaataaaaatcta

SEQ ID NO: 1359 - DNA, 20 bp, synthetic construct
  misc_feature 1..20: note = Synthetic oligonucleotide
  source 1..20: mol_type = other DNA
gccataggaattcttagcaa

SEQ ID NO: 1360 - DNA, 20 bp, synthetic construct
  misc_feature 1..20: note = Synthetic oligonucleotide
  source 1..20: mol_type = other DNA
aggtaagaaaacattattgc

SEQ ID NO: 1361 - DNA, 20 bp, synthetic construct
  misc_feature 1..20: note = Synthetic oligonucleotide
  source 1..20: mol_type = other DNA
tggcataccttaatagattt

SEQ ID NO: 1362 - DNA, 20 bp, synthetic construct
  misc_feature 1..20: note = Synthetic oligonucleotide
  source 1..20: mol_type = other DNA
gtgcatatattaacttaaaa

SEQ ID NO: 1363 - DNA, 20 bp, synthetic construct
  misc_feature 1..20: note = Synthetic oligonucleotide
  source 1..20: mol_type = other DNA
cagtagataactaaatgata

SEQ ID NO: 1364 - DNA, 20 bp, synthetic construct
  misc_feature 1..20: note = Synthetic oligonucleotide
  source 1..20: mol_type = other DNA
caagtttttacgcttgtggt

SEQ ID NO: 1365 - DNA, 20 bp, synthetic construct
  misc_feature 1..20: note = Synthetic oligonucleotide
  source 1..20: mol_type = other DNA
attattcaccattatagcct

SEQ ID NO: 1366 - DNA, 20 bp, synthetic construct
  misc_feature 1..20: note = Synthetic oligonucleotide
  source 1..20: mol_type = other DNA
tcatatctaattaaccatca

SEQ ID NO: 1367 - DNA, 20 bp, synthetic construct
  misc_feature 1..20: note = Synthetic oligonucleotide
  source 1..20: mol_type = other DNA
ccttatctcccttttccata

SEQ ID NO: 1368 - DNA, 20 bp, synthetic construct
  misc_feature 1..20: note = Synthetic oligonucleotide
  source 1..20: mol_type = other DNA
aaacaactatttaagaaaat

SEQ ID NO: 1369 - DNA, 20 bp, synthetic construct
  misc_feature 1..20: note = Synthetic oligonucleotide
  source 1..20: mol_type = other DNA
ctaccatgccttcaccacca

SEQ ID NO: 1370 - DNA, 20 bp, synthetic construct
  misc_feature 1..20: note = Synthetic oligonucleotide
  source 1..20: mol_type = other DNA
ccttggtctttcatcaagac

SEQ ID NO: 1371 - DNA, 20 bp, synthetic construct
  misc_feature 1..20: note = Synthetic oligonucleotide
  source 1..20: mol_type = other DNA
accaaataaacattttttaa

SEQ ID NO: 1372 - DNA, 20 bp, synthetic construct
  misc_feature 1..20: note = Synthetic oligonucleotide
  source 1..20: mol_type = other DNA
ttttgattatacaaatggtt

SEQ ID NO: 1373 - DNA, 20 bp, synthetic construct
  misc_feature 1..20: note = Synthetic oligonucleotide
  source 1..20: mol_type = other DNA
gctatacatttattaatcca

SEQ ID NO: 1374 - DNA, 20 bp, synthetic construct
  misc_feature 1..20: note = Synthetic oligonucleotide
  source 1..20: mol_type = other DNA
tcctgttttaatatatgcca

SEQ ID NO: 1375 - DNA, 20 bp, synthetic construct
  misc_feature 1..20: note = Synthetic oligonucleotide
  source 1..20: mol_type = other DNA
tagctttttcattatagtaa

SEQ ID NO: 1376 - DNA, 20 bp, synthetic construct
  misc_feature 1..20: note = Synthetic oligonucleotide
  source 1..20: mol_type = other DNA
tcatatttccacttactcta

SEQ ID NO: 1377 - DNA, 20 bp, synthetic construct
  misc_feature 1..20: note = Synthetic oligonucleotide
  source 1..20: mol_type = other DNA
tgttttttcatcattaccaa

SEQ ID NO: 1378 - DNA, 20 bp, synthetic construct
  misc_feature 1..20: note = Synthetic oligonucleotide
  source 1..20: mol_type = other DNA
agactgctacacattatgtt

SEQ ID NO: 1379 - DNA, 20 bp, synthetic construct
  misc_feature 1..20: note = Synthetic oligonucleotide
  source 1..20: mol_type = other DNA
acagaataaaaacttggcca

SEQ ID NO: 1380 - DNA, 20 bp, synthetic construct
  misc_feature 1..20: note = Synthetic oligonucleotide
  source 1..20: mol_type = other DNA
ttccatttcccttaatacat

SEQ ID NO: 1381 - DNA, 20 bp, synthetic construct
  misc_feature 1..20: note = Synthetic oligonucleotide
  source 1..20: mol_type = other DNA
ataactctcatatcaaacat

SEQ ID NO: 1382 - DNA, 20 bp, synthetic construct
  misc_feature 1..20: note = Synthetic oligonucleotide
  source 1..20: mol_type = other DNA
aactgcttactttctattaa

SEQ ID NO: 1383 - DNA, 20 bp, synthetic construct
  misc_feature 1..20: note = Synthetic oligonucleotide
  source 1..20: mol_type = other DNA
gtgattttccacattgactt

SEQ ID NO: 1384 - DNA, 20 bp, synthetic construct
  misc_feature 1..20: note = Synthetic oligonucleotide
  source 1..20: mol_type = other DNA
gtaccaaactatcttgctta

SEQ ID NO: 1385 - DNA, 20 bp, synthetic construct
  misc_feature 1..20: note = Synthetic oligonucleotide
  source 1..20: mol_type = other DNA
aatctattaactatgagtca

SEQ ID NO: 1386 - DNA, 20 bp, synthetic construct
  misc_feature 1..20: note = Synthetic oligonucleotide
  source 1..20: mol_type = other DNA
attaatttcttaataatatt

SEQ ID NO: 1387 - DNA, 20 bp, synthetic construct
  misc_feature 1..20: note = Synthetic oligonucleotide
  source 1..20: mol_type = other DNA
ctgattttaaaaaattggtt

SEQ ID NO: 1388 - DNA, 20 bp, synthetic construct
  misc_feature 1..20: note = Synthetic oligonucleotide
  source 1..20: mol_type = other DNA
tgagaataatatcaacactt

SEQ ID NO: 1389 - DNA, 20 bp, synthetic construct
  misc_feature 1..20: note = Synthetic oligonucleotide
  source 1..20: mol_type = other DNA
acaatctaaattaatactga

SEQ ID NO: 1390 - DNA, 20 bp, synthetic construct
  misc_feature 1..20: note = Synthetic oligonucleotide
  source 1..20: mol_type = other DNA
ataatttattcctaaaatca

SEQ ID NO: 1391 - DNA, 20 bp, synthetic construct
  misc_feature 1..20: note = Synthetic oligonucleotide
  source 1..20: mol_type = other DNA
ttgttttaattctctagttt

SEQ ID NO: 1392 - DNA, 20 bp, synthetic construct
  misc_feature 1..20: note = Synthetic oligonucleotide
  source 1..20: mol_type = other DNA
ataacatttttaaaaccaca

SEQ ID NO: 1393 - DNA, 20 bp, synthetic construct
  misc_feature 1..20: note = Synthetic oligonucleotide
  source 1..20: mol_type = other DNA
ctcttttatccaaccactaa

SEQ ID NO: 1394 - DNA, 20 bp, synthetic construct
  misc_feature 1..20: note = Synthetic oligonucleotide
  source 1..20: mol_type = other DNA
acatgtttttctaatttcct

SEQ ID NO: 1395 - DNA, 20 bp, synthetic construct
  misc_feature 1..20: note = Synthetic oligonucleotide
  source 1..20: mol_type = other DNA
gtacacttatcaattattac

SEQ ID NO: 1396 - DNA, 20 bp, synthetic construct
  misc_feature 1..20: note = Synthetic oligonucleotide
  source 1..20: mol_type = other DNA
cagtaattctcctaatgaaa

SEQ ID NO: 1397 - DNA, 20 bp, synthetic construct
  misc_feature 1..20: note = Synthetic oligonucleotide
  source 1..20: mol_type = other DNA
ctgtattaaataataagtcc

SEQ ID NO: 1398 - DNA, 20 bp, synthetic construct
  misc_feature 1..20: note = Synthetic oligonucleotide
  source 1..20: mol_type = other DNA
caagaggtaataacacacat

SEQ ID NO: 1399 - DNA, 20 bp, synthetic construct
  misc_feature 1..20: note = Synthetic oligonucleotide
  source 1..20: mol_type = other DNA
ttgttttcccatttaacgca

SEQ ID NO: 1400 - DNA, 20 bp, synthetic construct
  misc_feature 1..20: note = Synthetic oligonucleotide
  source 1..20: mol_type = other DNA
ctttgaacccagttttttca

SEQ ID NO: 1401 - DNA, 20 bp, synthetic construct
  misc_feature 1..20: note = Synthetic oligonucleotide
  source 1..20: mol_type = other DNA
cctcttttcctgtgtttcat

SEQ ID NO: 1402 - DNA, 20 bp, synthetic construct
  misc_feature 1..20: note = Synthetic oligonucleotide
  source 1..20: mol_type = other DNA
ctgttctcccatttaaatcc

SEQ ID NO: 1403 - DNA, 20 bp, synthetic construct
  misc_feature 1..20: note = Synthetic oligonucleotide
  source 1..20: mol_type = other DNA
aaagcacctcttcttaccta

SEQ ID NO: 1404 - DNA, 20 bp, synthetic construct
  misc_feature 1..20: note = Synthetic oligonucleotide
  source 1..20: mol_type = other DNA
tccaatgcaattcttcagaa

SEQ ID NO: 1405 - DNA, 20 bp, synthetic construct
  misc_feature 1..20: note = Synthetic oligonucleotide
  source 1..20: mol_type = other DNA
gagattgctttccctttatt

SEQ ID NO: 1406 - DNA, 20 bp, synthetic construct
  misc_feature 1..20: note = Synthetic oligonucleotide
  source 1..20: mol_type = other DNA
tagtaccattcccatccaat

SEQ ID NO: 1407 - DNA, 20 bp, synthetic construct
  misc_feature 1..20: note = Synthetic oligonucleotide
  source 1..20: mol_type = other DNA
tgtcatttttctcttcttct

SEQ ID NO: 1408 - DNA, 20 bp, synthetic construct
  misc_feature 1..20: note = Synthetic oligonucleotide
  source 1..20: mol_type = other DNA
ttagcaaatttataccagca

SEQ ID NO: 1409 - DNA, 20 bp, synthetic construct
  misc_feature 1..20: note = Synthetic oligonucleotide
  source 1..20: mol_type = other DNA
aactgacaatccttccacat

SEQ ID NO: 1410 - DNA, 20 bp, synthetic construct
  misc_feature 1..20: note = Synthetic oligonucleotide
  source 1..20: mol_type = other DNA
cctttgccttcttctatgct

SEQ ID NO: 1411 - DNA, 20 bp, synthetic construct
  misc_feature 1..20: note = Synthetic oligonucleotide
  source 1..20: mol_type = other DNA
gagattcactcccatgatac

SEQ ID NO: 1412 - DNA, 20 bp, synthetic construct
  misc_feature 1..20: note = Synthetic oligonucleotide
  source 1..20: mol_type = other DNA
agtttcagcacacattctcc

SEQ ID NO: 1413 - DNA, 20 bp, synthetic construct
  misc_feature 1..20: note = Synthetic oligonucleotide
  source 1..20: mol_type = other DNA
tcttggtttctttttacttt

SEQ ID NO: 1414 - DNA, 20 bp, synthetic construct
  misc_feature 1..20: note = Synthetic oligonucleotide
  source 1..20: mol_type = other DNA
tacatgtacatttaatgggt

SEQ ID NO: 1415 - DNA, 20 bp, synthetic construct
  misc_feature 1..20: note = Synthetic oligonucleotide
  source 1..20: mol_type = other DNA
tactatgtcaaccttaccaa

SEQ ID NO: 1416 - DNA, 20 bp, synthetic construct
  misc_feature 1..20: note = Synthetic oligonucleotide
  source 1..20: mol_type = other DNA
aaactatacttactgtggta

SEQ ID NO: 1417 - DNA, 20 bp, synthetic construct
  misc_feature 1..20: note = Synthetic oligonucleotide
  source 1..20: mol_type = other DNA
gcttcactttaccactgata

SEQ ID NO: 1418 - DNA, 20 bp, synthetic construct
  misc_feature 1..20: note = Synthetic oligonucleotide
  source 1..20: mol_type = other DNA
ctgaagatacttttaatttc

SEQ ID NO: 1419 - DNA, 20 bp, synthetic construct
  misc_feature 1..20: note = Synthetic oligonucleotide
  source 1..20: mol_type = other DNA
cccatattatatctgataca

SEQ ID NO: 1420 - DNA, 20 bp, synthetic construct
  misc_feature 1..20: note = Synthetic oligonucleotide
  source 1..20: mol_type = other DNA
atttcaccaacacactacaa

SEQ ID NO: 1421 - DNA, 20 bp, synthetic construct
  misc_feature 1..20: note = Synthetic oligonucleotide
  source 1..20: mol_type = other DNA
atgatagaaatctaccttta

SEQ ID NO: 1422 - DNA, 20 bp, synthetic construct
  misc_feature 1..20: note = Synthetic oligonucleotide
  source 1..20: mol_type = other DNA
ccaatacactcttcttaatt

SEQ ID NO: 1423 - DNA, 20 bp, synthetic construct
  misc_feature 1..20: note = Synthetic oligonucleotide
  source 1..20: mol_type = other DNA
gagtcattccactctttaac

SEQ ID NO: 1424 - DNA, 20 bp, synthetic construct
  misc_feature 1..20: note = Synthetic oligonucleotide
  source 1..20: mol_type = other DNA
tgctcattatcatcaaccac

SEQ ID NO: 1425 - DNA, 20 bp, synthetic construct
  misc_feature 1..20: note = Synthetic oligonucleotide
  source 1..20: mol_type = other DNA
gctaaattcctatcttctaa

SEQ ID NO: 1426 - DNA, 20 bp, synthetic construct
  misc_feature 1..20: note = Synthetic oligonucleotide
  source 1..20: mol_type = other DNA
catcttaaatttaaatgata

SEQ ID NO: 1427 - DNA, 20 bp, synthetic construct
  misc_feature 1..20: note = Synthetic oligonucleotide
  source 1..20: mol_type = other DNA
aaccatagagccatatttta

SEQ ID NO: 1428 - DNA, 20 bp, synthetic construct
  misc_feature 1..20: note = Synthetic oligonucleotide
  source 1..20: mol_type = other DNA
gatggctttttattacctta

SEQ ID NO: 1429 - DNA, 20 bp, synthetic construct
  misc_feature 1..20: note = Synthetic oligonucleotide
  source 1..20: mol_type = other DNA
acacttgattttaataaaca

SEQ ID NO: 1430 - DNA, 20 bp, synthetic construct
  misc_feature 1..20: note = Synthetic oligonucleotide
  source 1..20: mol_type = other DNA
cataattcctataattctca

SEQ ID NO: 1431 - DNA, 20 bp, synthetic construct
  misc_feature 1..20: note = Synthetic oligonucleotide
  source 1..20: mol_type = other DNA
gttcaaatcataatcacaaa

SEQ ID NO: 1432 - DNA, 20 bp, synthetic construct
  misc_feature 1..20: note = Synthetic oligonucleotide
  source 1..20: mol_type = other DNA
tcaagaattaccatttgctc

SEQ ID NO: 1433 - DNA, 20 bp, synthetic construct
  misc_feature 1..20: note = Synthetic oligonucleotide
  source 1..20: mol_type = other DNA
tatgtcataacctctagtga

SEQ ID NO: 1434 - DNA, 20 bp, synthetic construct
  misc_feature 1..20: note = Synthetic oligonucleotide
  source 1..20: mol_type = other DNA
gttccatcttcatcttgttc

SEQ ID NO: 1435 - DNA, 20 bp, synthetic construct
  misc_feature 1..20: note = Synthetic oligonucleotide
  source 1..20: mol_type = other DNA
acaaatgattctaattcaaa

SEQ ID NO: 1436 - DNA, 20 bp, synthetic construct
  misc_feature 1..20: note = Synthetic oligonucleotide
  source 1..20: mol_type = other DNA
ttatttataaatattgccct

SEQ ID NO: 1437 - DNA, 20 bp, synthetic construct
  misc_feature 1..20: note = Synthetic oligonucleotide
  source 1..20: mol_type = other DNA
ttatttatttctaatgctaa

SEQ ID NO: 1438 - DNA, 20 bp, synthetic construct
  misc_feature 1..20: note = Synthetic oligonucleotide
  source 1..20: mol_type = other DNA
agagactttttaaaatctaa

SEQ ID NO: 1439 - DNA, 20 bp, synthetic construct
  misc_feature 1..20: note = Synthetic oligonucleotide
  source 1..20: mol_type = other DNA
cttacaagaatatctaccac

SEQ ID NO: 1440 - DNA, 20 bp, synthetic construct
  misc_feature 1..20: note = Synthetic oligonucleotide
  source 1..20: mol_type = other DNA
tgtttaattttaatatgaac

SEQ ID NO: 1441 - DNA, 20 bp, synthetic construct
  misc_feature 1..20: note = Synthetic oligonucleotide
  source 1..20: mol_type = other DNA
ggtcaagtttttacgcttgt

SEQ ID NO: 1442 - DNA, 20 bp, synthetic construct
  misc_feature 1..20: note = Synthetic oligonucleotide
  source 1..20: mol_type = other DNA
aatcatgtctatattattca

SEQ ID NO: 1443 - DNA, 20 bp, synthetic construct
  misc_feature 1..20: note = Synthetic oligonucleotide
  source 1..20: mol_type = other DNA
tgctaattacttactccttt

SEQ ID NO: 1444 - DNA, 20 bp, synthetic construct
  misc_feature 1..20: note = Synthetic oligonucleotide
  source 1..20: mol_type = other DNA
aaacttttccacattgagac

SEQ ID NO: 1445 - DNA, 20 bp, synthetic construct
  misc_feature 1..20: note = Synthetic oligonucleotide
  source 1..20: mol_type = other DNA
ttgacattaaaaaacagcaa

SEQ ID NO: 1446 - DNA, 20 bp, synthetic construct
  misc_feature 1..20: note = Synthetic oligonucleotide
  source 1..20: mol_type = other DNA
cactaccatgccttcaccac

SEQ ID NO: 1447 - DNA, 20 bp, synthetic construct
  misc_feature 1..20: note = Synthetic oligonucleotide
  source 1..20: mol_type = other DNA
gggttcacacacaaacacaa

SEQ ID NO: 1448 - DNA, 20 bp, synthetic construct
  misc_feature 1..20: note = Synthetic oligonucleotide
  source 1..20: mol_type = other DNA
gacttatttattaaaatgac

SEQ ID NO: 1449 - DNA, 20 bp, synthetic construct
  misc_feature 1..20: note = Synthetic oligonucleotide
  source 1..20: mol_type = other DNA
attgaacaaatatcaatata

SEQ ID NO: 1450 - DNA, 20 bp, synthetic construct
  misc_feature 1..20: note = Synthetic oligonucleotide
  source 1..20: mol_type = other DNA
ttgagcgatctaaatagcta

SEQ ID NO: 1451 - DNA, 20 bp, synthetic construct
  misc_feature 1..20: note = Synthetic oligonucleotide
  source 1..20: mol_type = other DNA
ctgacctcaacatttaggtt

SEQ ID NO: 1452 - DNA, 20 bp, synthetic construct
  misc_feature 1..20: note = Synthetic oligonucleotide
  source 1..20: mol_type = other DNA
aagatcataataactttttc

SEQ ID NO: 1453 - DNA, 20 bp, synthetic construct
  misc_feature 1..20: note = Synthetic oligonucleotide
  source 1..20: mol_type = other DNA
aaacaattcatatttccact

SEQ ID NO: 1454 - DNA, 20 bp, synthetic construct
  misc_feature 1..20: note = Synthetic oligonucleotide
  source 1..20: mol_type = other DNA
aatgatacaatatcaagtca

SEQ ID NO: 1455 - DNA, 20 bp, synthetic construct
  misc_feature 1..20: note = Synthetic oligonucleotide
  source 1..20: mol_type = other DNA
aacacatttaacatatggca

SEQ ID NO: 1456 - DNA, 20 bp, synthetic construct
  misc_feature 1..20: note = Synthetic oligonucleotide
  source 1..20: mol_type = other DNA
cactactgcttcattaagca

SEQ ID NO: 1457 - DNA, 20 bp, synthetic construct
  misc_feature 1..20: note = Synthetic oligonucleotide
  source 1..20: mol_type = other DNA
gtttgtttccatttccctta

SEQ ID NO: 1458 - DNA, 20 bp, synthetic construct
  misc_feature 1..20: note = Synthetic oligonucleotide
  source 1..20: mol_type = other DNA
tcatggtaaacatttattta

SEQ ID NO: 1459 - DNA, 20 bp, synthetic construct
  misc_feature 1..20: note = Synthetic oligonucleotide
  source 1..20: mol_type = other DNA
atcttctaataaataagcaa

SEQ ID NO: 1460 - DNA, 20 bp, synthetic construct
  misc_feature 1..20: note = Synthetic oligonucleotide
  source 1..20: mol_type = other DNA
aaaggagcttaaattagcaa

SEQ ID NO: 1461 - DNA, 20 bp, synthetic construct
  misc_feature 1..20: note = Synthetic oligonucleotide
  source 1..20: mol_type = other DNA
gcttctttccttaataaaat

SEQ ID NO: 1462 - DNA, 20 bp, synthetic construct
  misc_feature 1..20: note = Synthetic oligonucleotide
  source 1..20: mol_type = other DNA
caacatatttacaatagtgc

SEQ ID NO: 1463 - DNA, 20 bp, synthetic construct
  misc_feature 1..20: note = Synthetic oligonucleotide
  source 1..20: mol_type = other DNA
gtcagttcatcaatttctac

SEQ ID NO: 1464 - DNA, 20 bp, synthetic construct
  misc_feature 1..20: note = Synthetic oligonucleotide
  source 1..20: mol_type = other DNA
gactaattaattacaaagta

SEQ ID NO: 1465 - DNA, 20 bp, synthetic construct
  misc_feature 1..20: note = Synthetic oligonucleotide
  source 1..20: mol_type = other DNA
ctcattatttttaaaaggcc

SEQ ID NO: 1466 - DNA, 20 bp, synthetic construct
  misc_feature 1..20: note = Synthetic oligonucleotide
  source 1..20: mol_type = other DNA
attattttataaactatatc

SEQ ID NO: 1467 - DNA, 20 bp, synthetic construct
  misc_feature 1..20: note = Synthetic oligonucleotide
  source 1..20: mol_type = other DNA
actattatcactatttgctt

SEQ ID NO: 1468 - DNA, 20 bp, synthetic construct
  misc_feature 1..20: note = Synthetic oligonucleotide
  source 1..20: mol_type = other DNA
atgatgtttcttactacttt

SEQ ID NO: 1469 - DNA, 20 bp, synthetic construct
  misc_feature 1..20: note = Synthetic oligonucleotide
  source 1..20: mol_type = other DNA
gtaaaatcaaaataattact

SEQ ID NO: 1470 - DNA, 20 bp, synthetic construct
  misc_feature 1..20: note = Synthetic oligonucleotide
  source 1..20: mol_type = other DNA
atacctttttcctaaagcca

SEQ ID NO: 1471 - DNA, 20 bp, synthetic construct
  misc_feature 1..20: note = Synthetic oligonucleotide
  source 1..20: mol_type = other DNA
aaaaataatcctaatatctt

SEQ ID NO: 1472 - DNA, 20 bp, synthetic construct
  misc_feature 1..20: note = Synthetic oligonucleotide
  source 1..20: mol_type = other DNA
aaagatttcataatatttct

SEQ ID NO: 1473 - DNA, 20 bp, synthetic construct
  misc_feature 1..20: note = Synthetic oligonucleotide
  source 1..20: mol_type = other DNA
agctgcttctctctacatca

SEQ ID NO: 1474 - DNA, 20 bp, synthetic construct
  misc_feature 1..20: note = Synthetic oligonucleotide
  source 1..20: mol_type = other DNA
ataaatctcctttctattcc

SEQ ID NO: 1475 - DNA, 20 bp, synthetic construct
  misc_feature 1..20: note = Synthetic oligonucleotide
  source 1..20: mol_type = other DNA
tacttatttttaaacattat

SEQ ID NO: 1476 - DNA, 20 bp, synthetic construct
  misc_feature 1..20: note = Synthetic oligonucleotide
  source 1..20: mol_type = other DNA
aaggattatttaactatttt

SEQ ID NO: 1477 - DNA, 20 bp, synthetic construct
  misc_feature 1..20: note = Synthetic oligonucleotide
  source 1..20: mol_type = other DNA
ttctttgaacccagtttttt

SEQ ID NO: 1478 - DNA, 20 bp, synthetic construct
  misc_feature 1..20: note = Synthetic oligonucleotide
  source 1..20: mol_type = other DNA
tccctcttttcctgtgtttc

SEQ ID NO: 1479 - DNA, 20 bp, synthetic construct
  misc_feature 1..20: note = Synthetic oligonucleotide
  source 1..20: mol_type = other DNA
ggtcttaattttaatatcac

SEQ ID NO: 1480 - DNA, 20 bp, synthetic construct
  misc_feature 1..20: note = Synthetic oligonucleotide
  source 1..20: mol_type = other DNA
ttccaattatttaagaggtc

SEQ ID NO: 1481 - DNA, 20 bp, synthetic construct
  misc_feature 1..20: note = Synthetic oligonucleotide
  source 1..20: mol_type = other DNA
ataacagtctccaatgcaat

SEQ ID NO: 1482 - DNA, 20 bp, synthetic construct
  misc_feature 1..20: note = Synthetic oligonucleotide
  source 1..20: mol_type = other DNA
gagagattgctttcccttta

SEQ ID NO: 1483 - DNA, 20 bp, synthetic construct
  misc_feature 1..20: note = Synthetic oligonucleotide
  source 1..20: mol_type = other DNA
gtagtaccattcccatccaa

SEQ ID NO: 1484 - DNA, 20 bp, synthetic construct
  misc_feature 1..20: note = Synthetic oligonucleotide
  source 1..20: mol_type = other DNA
ctgtcatttttctcttcttc

SEQ ID NO: 1485 - DNA, 20 bp, synthetic construct
  misc_feature 1..20: note = Synthetic oligonucleotide
  source 1..20: mol_type = other DNA
attagcaaatttataccagc

SEQ ID NO: 1486 - DNA, 20 bp, synthetic construct
  misc_feature 1..20: note = Synthetic oligonucleotide
  source 1..20: mol_type = other DNA
agaactgacaatccttccac

SEQ ID NO: 1487 - DNA, 20 bp, synthetic construct
  misc_feature 1..20: note = Synthetic oligonucleotide
  source 1..20: mol_type = other DNA
accagagtttccctttgcct

SEQ ID NO: 1488 - DNA, 20 bp, synthetic construct
  misc_feature 1..20: note = Synthetic oligonucleotide
  source 1..20: mol_type = other DNA
tgtaattaatacaatggtaa

SEQ ID NO: 1489 - DNA, 20 bp, synthetic construct
  misc_feature 1..20: note = Synthetic oligonucleotide
  source 1..20: mol_type = other DNA
tcgaagggcatccatctctc

SEQ ID NO: 1490 - DNA, 20 bp, synthetic construct
  misc_feature 1..20: note = Synthetic oligonucleotide
  source 1..20: mol_type = other DNA
ttcttggtttctttttactt

SEQ ID NO: 1491 - DNA, 20 bp, synthetic construct
  misc_feature 1..20: note = Synthetic oligonucleotide
  source 1..20: mol_type = other DNA
tatcaaaaatgtgatagtca

SEQ ID NO: 1492 - DNA, 20 bp, synthetic construct
  misc_feature 1..20: note = Synthetic oligonucleotide
  source 1..20: mol_type = other DNA
aattgacatatactatgtca

SEQ ID NO: 1493 - DNA, 20 bp, synthetic construct
  misc_feature 1..20: note = Synthetic oligonucleotide
  source 1..20: mol_type = other DNA
ttgcaaactatacttactgt

SEQ ID NO: 1494 - DNA, 20 bp, synthetic construct
  misc_feature 1..20: note = Synthetic oligonucleotide
  source 1..20: mol_type = other DNA
tgcttcactttaccactgat

SEQ ID NO: 1495 - DNA, 20 bp, synthetic construct
  misc_feature 1..20: note = Synthetic oligonucleotide
  source 1..20: mol_type = other DNA
gtgacatccacctgaagata

SEQ ID NO: 1496 - DNA, 20 bp, synthetic construct
  misc_feature 1..20: note = Synthetic oligonucleotide
  source 1..20: mol_type = other DNA
tcccatattatatctgatac

SEQ ID NO: 1497 - DNA, 20 bp, synthetic construct
  misc_feature 1..20: note = Synthetic oligonucleotide
  source 1..20: mol_type = other DNA
gcatttcaccaacacactac

SEQ ID NO: 1498 - DNA, 20 bp, synthetic construct
  misc_feature 1..20: note = Synthetic oligonucleotide
  source 1..20: mol_type = other DNA
catgatagaaatctaccttt

SEQ ID NO: 1499 - DNA, 20 bp, synthetic construct
  misc_feature 1..20: note = Synthetic oligonucleotide
  source 1..20: mol_type = other DNA
atccaatacactcttcttaa

SEQ ID NO: 1500 - DNA, 20 bp, synthetic construct
  misc_feature 1..20: note = Synthetic oligonucleotide
  source 1..20: mol_type = other DNA
gttattctaataataatcaa

SEQ ID NO: 1501 - DNA, 20 bp, synthetic construct
  misc_feature 1..20: note = Synthetic oligonucleotide
  source 1..20: mol_type = other DNA
atacttcatcttacaaacaa

SEQ ID NO: 1502 - DNA, 20 bp, synthetic construct
  misc_feature 1..20: note = Synthetic oligonucleotide
  source 1..20: mol_type = other DNA
ttttataacactaatatgca

SEQ ID NO: 1503 - DNA, 20 bp, synthetic construct
  misc_feature 1..20: note = Synthetic oligonucleotide
  source 1..20: mol_type = other DNA
tttgttcatcttaaatttaa

SEQ ID NO: 1504 - DNA, 20 bp, synthetic construct
  misc_feature 1..20: note = Synthetic oligonucleotide
  source 1..20: mol_type = other DNA
taaaccatagagccatattt

SEQ ID NO: 1505 - DNA, 20 bp, synthetic construct
  misc_feature 1..20: note = Synthetic oligonucleotide
  source 1..20: mol_type = other DNA
aagttcaaaatcatattctt

SEQ ID NO: 1506 - DNA, 20 bp, synthetic construct
  misc_feature 1..20: note = Synthetic oligonucleotide
  source 1..20: mol_type = other DNA
gatacatatttaaattacaa

SEQ ID NO: 1507 - DNA, 20 bp, synthetic construct
  misc_feature 1..20: note = Synthetic oligonucleotide
  source 1..20: mol_type = other DNA
accataattcctataattct

SEQ ID NO: 1508 - DNA, 20 bp, synthetic construct
  misc_feature 1..20: note = Synthetic oligonucleotide
  source 1..20: mol_type = other DNA
atttttctcactcccaacca

SEQ ID NO: 1509 - DNA, 20 bp, synthetic construct
  misc_feature 1..20: note = Synthetic oligonucleotide
  source 1..20: mol_type = other DNA
attaaatatttcctttgctt

SEQ ID NO: 1510 - DNA, 20 bp, synthetic construct
  misc_feature 1..20: note = Synthetic oligonucleotide
  source 1..20: mol_type = other DNA
cctctctctctcatacacta

SEQ ID NO: 1511 - DNA, 20 bp, synthetic construct
  misc_feature 1..20: note = Synthetic oligonucleotide
  source 1..20: mol_type = other DNA
ccctggttccatcttcatct

SEQ ID NO: 1512 - DNA, 20 bp, synthetic construct
  misc_feature 1..20: note = Synthetic oligonucleotide
  source 1..20: mol_type = other DNA
agcaatataccaacttgtta

SEQ ID NO: 1513 - DNA, 20 bp, synthetic construct
  misc_feature 1..20: note = Synthetic oligonucleotide
  source 1..20: mol_type = other DNA
gctcaataacttggtcaaag

SEQ ID NO: 1514 - DNA, 20 bp, synthetic construct
  misc_feature 1..20: note = Synthetic oligonucleotide
  source 1..20: mol_type = other DNA
tagatcataatttataatca

SEQ ID NO: 1515 - DNA, 20 bp, synthetic construct
  misc_feature 1..20: note = Synthetic oligonucleotide
  source 1..20: mol_type = other DNA
tagagactttttaaaatcta

SEQ ID NO: 1516 - DNA, 20 bp, synthetic construct
  misc_feature 1..20: note = Synthetic oligonucleotide
  source 1..20: mol_type = other DNA
ttcttcttccaaacacacac

SEQ ID NO: 1517 - DNA, 20 bp, synthetic construct
  misc_feature 1..20: note = Synthetic oligonucleotide
  source 1..20: mol_type = other DNA
ttgtttaattttaatatgaa

SEQ ID NO: 1518 - DNA, 20 bp, synthetic construct
  misc_feature 1..20: note = Synthetic oligonucleotide
  source 1..20: mol_type = other DNA
gggtcaagtttttacgcttg

SEQ ID NO: 1519 - DNA, 20 bp, synthetic construct
  misc_feature 1..20: note = Synthetic oligonucleotide
  source 1..20: mol_type = other DNA
atgatcttctcaactactct

SEQ ID NO: 1520 - DNA, 20 bp, synthetic construct
  misc_feature 1..20: note = Synthetic oligonucleotide
  source 1..20: mol_type = other DNA
tcctgctaattacttactcc

SEQ ID NO: 1521 - DNA, 20 bp, synthetic construct
  misc_feature 1..20: note = Synthetic oligonucleotide
  source 1..20: mol_type = other DNA
aacttattttctactttaca

SEQ ID NO: 1522 - DNA, 20 bp, synthetic construct
  misc_feature 1..20: note = Synthetic oligonucleotide
  source 1..20: mol_type = other DNA
tggtttcaccctatcccact

SEQ ID NO: 1523 - DNA, 20 bp, synthetic construct
  misc_feature 1..20: note = Synthetic oligonucleotide
  source 1..20: mol_type = other DNA
tgcactaccatgccttcacc

SEQ ID NO: 1524 - DNA, 20 bp, synthetic construct
  misc_feature 1..20: note = Synthetic oligonucleotide
  source 1..20: mol_type = other DNA
ttacttttatcctcaatata

SEQ ID NO: 1525 - DNA, 20 bp, synthetic construct
  misc_feature 1..20: note = Synthetic oligonucleotide
  source 1..20: mol_type = other DNA
actactgacttatttattaa

SEQ ID NO: 1526 - DNA, 20 bp, synthetic construct
  misc_feature 1..20: note = Synthetic oligonucleotide
  source 1..20: mol_type = other DNA
tttttcacaatattgaacaa

SEQ ID NO: 1527 - DNA, 20 bp, synthetic construct
  misc_feature 1..20: note = Synthetic oligonucleotide
  source 1..20: mol_type = other DNA
ataataacaattacaagcac

SEQ ID NO: 1528 - DNA, 20 bp, synthetic construct
  misc_feature 1..20: note = Synthetic oligonucleotide
  source 1..20: mol_type = other DNA
aataacttcttaataaccaa

SEQ ID NO: 1529 - DNA, 20 bp, synthetic construct
  misc_feature 1..20: note = Synthetic oligonucleotide
  source 1..20: mol_type = other DNA
tcaaagatcataataacttt

SEQ ID NO: 1530 - DNA, 20 bp, synthetic construct
  misc_feature 1..20: note = Synthetic oligonucleotide
  source 1..20: mol_type = other DNA
tttcaaaaaaatccagatta

SEQ ID NO: 1531 - DNA, 20 bp, synthetic construct
  misc_feature 1..20: note = Synthetic oligonucleotide
  source 1..20: mol_type = other DNA
attttactgttatttagtaa

SEQ ID NO: 1532 - DNA, 20 bp, synthetic construct
  misc_feature 1..20: note = Synthetic oligonucleotide
  source 1..20: mol_type = other DNA
acaaattaacacatttaaca

SEQ ID NO: 1533 - DNA, 20 bp, synthetic construct
  misc_feature 1..20: note = Synthetic oligonucleotide
  source 1..20: mol_type = other DNA
ttttgcttatccactactgc

SEQ ID NO: 1534 - DNA, 20 bp, synthetic construct
  misc_feature 1..20: note = Synthetic oligonucleotide
  source 1..20: mol_type = other DNA
cagtttgtttccatttccct

SEQ ID NO: 1535 - DNA, 20 bp, synthetic construct
  misc_feature 1..20: note = Synthetic oligonucleotide
  source 1..20: mol_type = other DNA
atataattcatacattttca

SEQ ID NO: 1536 - DNA, 20 bp, synthetic construct
  misc_feature 1..20: note = Synthetic oligonucleotide
  source 1..20: mol_type = other DNA
aggttcttaaaaatatgtca

SEQ ID NO: 1537 - DNA, 20 bp, synthetic construct
  misc_feature 1..20: note = Synthetic oligonucleotide
  source 1..20: mol_type = other DNA
tgctattctttatctagttt

SEQ ID NO: 1538 - DNA, 20 bp, synthetic construct
  misc_feature 1..20: note = Synthetic oligonucleotide
  source 1..20: mol_type = other DNA
aaggcttctttccttaataa

SEQ ID NO: 1539 - DNA, 20 bp, synthetic construct
  misc_feature 1..20: note = Synthetic oligonucleotide
  source 1..20: mol_type = other DNA
ttgctcaacatatttacaat

SEQ ID NO: 1540 - DNA, 20 bp, synthetic construct
  misc_feature 1..20: note = Synthetic oligonucleotide
  source 1..20: mol_type = other DNA
agtcagttcatcaatttcta

SEQ ID NO: 1541 - DNA, 20 bp, synthetic construct
  misc_feature 1..20: note = Synthetic oligonucleotide
  source 1..20: mol_type = other DNA
gaagactaattaattacaaa

SEQ ID NO: 1542 - DNA, 20 bp, synthetic construct
  misc_feature 1..20: note = Synthetic oligonucleotide
  source 1..20: mol_type = other DNA
ttttgtttctccttaaggaa

SEQ ID NO: 1543 - DNA, 20 bp, synthetic construct
  misc_feature 1..20: note = Synthetic oligonucleotide
  source 1..20: mol_type = other DNA
aatgattattttataaacta

SEQ ID NO: 1544 - DNA, 20 bp, synthetic construct
  misc_feature 1..20: note = Synthetic oligonucleotide
  source 1..20: mol_type = other DNA
gttcttgacaccttatttta

SEQ ID NO: 1545 - DNA, 20 bp, synthetic construct
  misc_feature 1..20: note = Synthetic oligonucleotide
  source 1..20: mol_type = other DNA
cctcattttttctttaatta

SEQ ID NO: 1546 - DNA, 20 bp, synthetic construct
  misc_feature 1..20: note = Synthetic oligonucleotide
  source 1..20: mol_type = other DNA
taacttcctattaaattttt

SEQ ID NO: 1547 - DNA, 20 bp, synthetic construct
  misc_feature 1..20: note = Synthetic oligonucleotide
  source 1..20: mol_type = other DNA
ttagtgcactaccttagttc

SEQ ID NO: 1548 - DNA, 20 bp, synthetic construct
  misc_feature 1..20: note = Synthetic oligonucleotide
  source 1..20: mol_type = other DNA
gtatatcaaattactagaaa

SEQ ID NO: 1549 - DNA, 20 bp, synthetic construct
  misc_feature 1..20: note = Synthetic oligonucleotide
  source 1..20: mol_type = other DNA
ctatttcccatctttattat

SEQ ID NO: 1550 - DNA, 20 bp, synthetic construct
  misc_feature 1..20: note = Synthetic oligonucleotide
  source 1..20: mol_type = other DNA
gtaatttttaaattttggtc

SEQ ID NO: 1551 - DNA, 20 bp, synthetic construct
  misc_feature 1..20: note = Synthetic oligonucleotide
  source 1..20: mol_type = other DNA
tgatctctaaataaatctcc

SEQ ID NO: 1552 - DNA, 20 bp, synthetic construct
  misc_feature 1..20: note = Synthetic oligonucleotide
  source 1..20: mol_type = other DNA
ttacttatttttaaacatta

SEQ ID NO: 1553 - DNA, 20 bp, synthetic construct
  misc_feature 1..20: note = Synthetic oligonucleotide
  source 1..20: mol_type = other DNA
aaaggattatttaactattt

SEQ ID NO: 1554 - DNA, 20 bp, synthetic construct
  misc_feature 1..20: note = Synthetic oligonucleotide
  source 1..20: mol_type = other DNA
tttctttgaacccagttttt

SEQ ID NO: 1555 - DNA, 20 bp, synthetic construct
  misc_feature 1..20: note = Synthetic oligonucleotide
  source 1..20: mol_type = other DNA
ctccctcttttcctgtgttt

SEQ ID NO: 1556 - DNA, 20 bp, synthetic construct
  misc_feature 1..20: note = Synthetic oligonucleotide
  source 1..20: mol_type = other DNA
gtttatctgtctactattct

SEQ ID NO: 1557 - DNA, 20 bp, synthetic construct
  misc_feature 1..20: note = Synthetic oligonucleotide
  source 1..20: mol_type = other DNA
atcttttgcattcctaggac

SEQ ID NO: 1558 - DNA, 20 bp, synthetic construct
  misc_feature 1..20: note = Synthetic oligonucleotide
  source 1..20: mol_type = other DNA
ccaatgcaattcttcagaat

SEQ ID NO: 1559 - DNA, 20 bp, synthetic construct
  misc_feature 1..20: note = Synthetic oligonucleotide
  source 1..20: mol_type = other DNA
agattgctttccctttattc

SEQ ID NO: 1560 - DNA, 20 bp, synthetic construct
  misc_feature 1..20: note = Synthetic oligonucleotide
  source 1..20: mol_type = other DNA
taccattcccatccaatgaa

SEQ ID NO: 1561 - DNA, 20 bp, synthetic construct
  misc_feature 1..20: note = Synthetic oligonucleotide
  source 1..20: mol_type = other DNA
tcatttttctcttcttctcc

SEQ ID NO: 1562 - DNA, 20 bp, synthetic construct
  misc_feature 1..20: note = Synthetic oligonucleotide
  source 1..20: mol_type = other DNA
tagcaaatttataccagcat

SEQ ID NO: 1563 - DNA, 20 bp, synthetic construct
  misc_feature 1..20: note = Synthetic oligonucleotide
  source 1..20: mol_type = other DNA
ctgacaatccttccacattt

SEQ ID NO: 1564 - DNA, 20 bp, synthetic construct
  misc_feature 1..20: note = Synthetic oligonucleotide
  source 1..20: mol_type = other DNA
ctttgccttcttctatgctt

SEQ ID NO: 1565 - DNA, 20 bp, synthetic construct
  misc_feature 1..20: note = Synthetic oligonucleotide
  source 1..20: mol_type = other DNA
atgatactgaatattagcca

SEQ ID NO: 1566 - DNA, 20 bp, synthetic construct
  misc_feature 1..20: note = Synthetic oligonucleotide
  source 1..20: mol_type = other DNA
atgtttgtcatttcttgact

SEQ ID NO: 1567 - DNA, 20 bp, synthetic construct
  misc_feature 1..20: note = Synthetic oligonucleotide
  source 1..20: mol_type = other DNA
ggtttctttttactttttac

SEQ ID NO: 1568 - DNA, 20 bp, synthetic construct
  misc_feature 1..20: note = Synthetic oligonucleotide
  source 1..20: mol_type = other DNA
acatgtacatttaatgggtt

SEQ ID NO: 1569 - DNA, 20 bp, synthetic construct
  misc_feature 1..20: note = Synthetic oligonucleotide
  source 1..20: mol_type = other DNA
atgtcaaccttaccaagagc

SEQ ID NO: 1570 - DNA, 20 bp, synthetic construct
  misc_feature 1..20: note = Synthetic oligonucleotide
  source 1..20: mol_type = other DNA
agtagtgtgcttaaatcatc

SEQ ID NO: 1571 - DNA, 20 bp, synthetic construct
  misc_feature 1..20: note = Synthetic oligonucleotide
  source 1..20: mol_type = other DNA
ttcactttaccactgatata

SEQ ID NO: 1572 - DNA, 20 bp, synthetic construct
  misc_feature 1..20: note = Synthetic oligonucleotide
  source 1..20: mol_type = other DNA
tgaagatacttttaatttct

SEQ ID NO: 1573 - DNA, 20 bp, synthetic construct
  misc_feature 1..20: note = Synthetic oligonucleotide
  source 1..20: mol_type = other DNA
aataagatctatctgtgtaa

SEQ ID NO: 1574 - DNA, 20 bp, synthetic construct
  misc_feature 1..20: note = Synthetic oligonucleotide
  source 1..20: mol_type = other DNA
ttcaccaacacactacaagt

SEQ ID NO: 1575 - DNA, 20 bp, synthetic construct
  misc_feature 1..20: note = Synthetic oligonucleotide
  source 1..20: mol_type = other DNA
tgatagaaatctacctttaa

SEQ ID NO: 1576 - DNA, 20 bp, synthetic construct
  misc_feature 1..20: note = Synthetic oligonucleotide
  source 1..20: mol_type = other DNA
caatacactcttcttaatta

SEQ ID NO: 1577 - DNA, 20 bp, synthetic construct
  misc_feature 1..20: note = Synthetic oligonucleotide
  source 1..20: mol_type = other DNA
ttccactctttaacacagat

SEQ ID NO: 1578 - DNA, 20 bp, synthetic construct
  misc_feature 1..20: note = Synthetic oligonucleotide
  source 1..20: mol_type = other DNA
gcattttcaaaccttccttc

SEQ ID NO: 1579 - DNA, 20 bp, synthetic construct
  misc_feature 1..20: note = Synthetic oligonucleotide
  source 1..20: mol_type = other DNA
taatttgaatccatatttta

SEQ ID NO: 1580 - DNA, 20 bp, synthetic construct
  misc_feature 1..20: note = Synthetic oligonucleotide
  source 1..20: mol_type = other DNA
tgatatatttatactagtta

SEQ ID NO: 1581 - DNA, 20 bp, synthetic construct
  misc_feature 1..20: note = Synthetic oligonucleotide
  source 1..20: mol_type = other DNA
accatagagccatattttaa

SEQ ID NO: 1582 - DNA, 20 bp, synthetic construct
  misc_feature 1..20: note = Synthetic oligonucleotide
  source 1..20: mol_type = other DNA
tccttttttttaaccatcta

SEQ ID NO: 1583 - DNA, 20 bp, synthetic construct
  misc_feature 1..20: note = Synthetic oligonucleotide
  source 1..20: mol_type = other DNA
cacttgattttaataaacat

SEQ ID NO: 1584 - DNA, 20 bp, synthetic construct
  misc_feature 1..20: note = Synthetic oligonucleotide
  source 1..20: mol_type = other DNA
cttcagtctacattttgccc

SEQ ID NO: 1585 - DNA, 20 bp, synthetic construct
  misc_feature 1..20: note = Synthetic oligonucleotide
  source 1..20: mol_type = other DNA
atcataatcacaaattataa

SEQ ID NO: 1586 - DNA, 20 bp, synthetic construct
  misc_feature 1..20: note = Synthetic oligonucleotide
  source 1..20: mol_type = other DNA
ataagctctttaacatttta

SEQ ID NO: 1587 - DNA, 20 bp, synthetic construct
  misc_feature 1..20: note = Synthetic oligonucleotide
  source 1..20: mol_type = other DNA
ttggatccaatcatttctca

SEQ ID NO: 1588 - DNA, 20 bp, synthetic construct
  misc_feature 1..20: note = Synthetic oligonucleotide
  source 1..20: mol_type = other DNA
tgaccaacattctttagata

SEQ ID NO: 1589 - DNA, 20 bp, synthetic construct
  misc_feature 1..20: note = Synthetic oligonucleotide
  source 1..20: mol_type = other DNA
tctactttttttaataaaaa

SEQ ID NO: 1590 - DNA, 20 bp, synthetic construct
  misc_feature 1..20: note = Synthetic oligonucleotide
  source 1..20: mol_type = other DNA
gtgtataacataataattac

SEQ ID NO: 1591 - DNA, 20 bp, synthetic construct
  misc_feature 1..20: note = Synthetic oligonucleotide
  source 1..20: mol_type = other DNA
atctttttccccacatgcta

SEQ ID NO: 1592 - DNA, 20 bp, synthetic construct
  misc_feature 1..20: note = Synthetic oligonucleotide
  source 1..20: mol_type = other DNA
atcaacagctcaacttggca

SEQ ID NO: 1593 - DNA, 20 bp, synthetic construct
  misc_feature 1..20: note = Synthetic oligonucleotide
  source 1..20: mol_type = other DNA
ttacaagaatatctaccaca

SEQ ID NO: 1594 - DNA, 20 bp, synthetic construct
  misc_feature 1..20: note = Synthetic oligonucleotide
  source 1..20: mol_type = other DNA
gaacaaactcctatttgcca

SEQ ID NO: 1595 - DNA, 20 bp, synthetic construct
  misc_feature 1..20: note = Synthetic oligonucleotide
  source 1..20: mol_type = other DNA
gtcaagtttttacgcttgtg

SEQ ID NO: 1596 - DNA, 20 bp, synthetic construct
  misc_feature 1..20: note = Synthetic oligonucleotide
  source 1..20: mol_type = other DNA
atattattcaccattatagc

SEQ ID NO: 1597 - DNA, 20 bp, synthetic construct
  misc_feature 1..20: note = Synthetic oligonucleotide
  source 1..20: mol_type = other DNA
cctatgagaaatcttagatt

SEQ ID NO: 1598 - DNA, 20 bp, synthetic construct
  misc_feature 1..20: note = Synthetic oligonucleotide
  source 1..20: mol_type = other DNA
gccttatctcccttttccat

SEQ ID NO: 1599 - DNA, 20 bp, synthetic construct
  misc_feature 1..20: note = Synthetic oligonucleotide
  source 1..20: mol_type = other DNA
aaaaccaaaacaactattta

SEQ ID NO: 1600 - DNA, 20 bp, synthetic construct
  misc_feature 1..20: note = Synthetic oligonucleotide
  source 1..20: mol_type = other DNA
actaccatgccttcaccacc

SEQ ID NO: 1601 - DNA, 20 bp, synthetic construct
  misc_feature 1..20: note = Synthetic oligonucleotide
  source 1..20: mol_type = other DNA
gtagaattaaatcagagtta

SEQ ID NO: 1602 - DNA, 20 bp, synthetic construct
  misc_feature 1..20: note = Synthetic oligonucleotide
  source 1..20: mol_type = other DNA
tgtctaccaaataaacattt

SEQ ID NO: 1603 - DNA, 20 bp, synthetic construct
  misc_feature 1..20: note = Synthetic oligonucleotide
  source 1..20: mol_type = other DNA
gaacaaatatcaatatataa

SEQ ID NO: 1604 - DNA, 20 bp, synthetic construct
  misc_feature 1..20: note = Synthetic oligonucleotide
  source 1..20: mol_type = other DNA
agctatacatttattaatcc

SEQ ID NO: 1605 - DNA, 20 bp, synthetic construct
  misc_feature 1..20: note = Synthetic oligonucleotide
  source 1..20: mol_type = other DNA
acactggctataattaggtt

SEQ ID NO: 1606 - DNA, 20 bp, synthetic construct
  misc_feature 1..20: note = Synthetic oligonucleotide
  source 1..20: mol_type = other DNA
ataactttttctattgctat

SEQ ID NO: 1607 - DNA, 20 bp, synthetic construct
  misc_feature 1..20: note = Synthetic oligonucleotide
  source 1..20: mol_type = other DNA
ttcatatttccacttactct

SEQ ID NO: 1608 - DNA, 20 bp, synthetic construct
  misc_feature 1..20: note = Synthetic oligonucleotide
  source 1..20: mol_type = other DNA
gaagtgttttttcatcatta

SEQ ID NO: 1609 - DNA, 20 bp, synthetic construct
  misc_feature 1..20: note = Synthetic oligonucleotide
  source 1..20: mol_type = other DNA
ccaaagtctttattttggca

SEQ ID NO: 1610 - DNA, 20 bp, synthetic construct
  misc_feature 1..20: note = Synthetic oligonucleotide
  source 1..20: mol_type = other DNA
gtcagttttcattctagata

SEQ ID NO: 1611 - DNA, 20 bp, synthetic construct
  misc_feature 1..20: note = Synthetic oligonucleotide
  source 1..20: mol_type = other DNA
gtttccatttcccttaatac

SEQ ID NO: 1612 - DNA, 20 bp, synthetic construct
  misc_feature 1..20: note = Synthetic oligonucleotide
  source 1..20: mol_type = other DNA
aaacatttatttaaatgtat

SEQ ID NO: 1613 - DNA, 20 bp, synthetic construct
  misc_feature 1..20: note = Synthetic oligonucleotide
  source 1..20: mol_type = other DNA
tttttgttatttaaaaggga

SEQ ID NO: 1614 - DNA, 20 bp, synthetic construct
  misc_feature 1..20: note = Synthetic oligonucleotide
  source 1..20: mol_type = other DNA
tcttattgactcattggtta

SEQ ID NO: 1615 - DNA, 20 bp, synthetic construct
  misc_feature 1..20: note = Synthetic oligonucleotide
  source 1..20: mol_type = other DNA
ttgttgaaaattaatttaac

SEQ ID NO: 1616 - DNA, 20 bp, synthetic construct
  misc_feature 1..20: note = Synthetic oligonucleotide
  source 1..20: mol_type = other DNA
tttgtttattctaacaattt

SEQ ID NO: 1617 - DNA, 20 bp, synthetic construct
  misc_feature 1..20: note = Synthetic oligonucleotide
  source 1..20: mol_type = other DNA
tgtgacatttttactgggat

SEQ ID NO: 1618 - DNA, 20 bp, synthetic construct
  misc_feature 1..20: note = Synthetic oligonucleotide
  source 1..20: mol_type = other DNA
gcaacttaatttactcccaa

SEQ ID NO: 1619 - DNA, 20 bp, synthetic construct
  misc_feature 1..20: note = Synthetic oligonucleotide
  source 1..20: mol_type = other DNA
tcattatttttaaaaggcca

SEQ ID NO: 1620 - DNA, 20 bp, synthetic construct
  misc_feature 1..20: note = Synthetic oligonucleotide
  source 1..20: mol_type = other DNA
tacatcacaatctaaattaa

SEQ ID NO: 1621 - DNA, 20 bp, synthetic construct
  misc_feature 1..20: note = Synthetic oligonucleotide
  source 1..20: mol_type = other DNA
cactgataatttattcctaa

SEQ ID NO: 1622 - DNA, 20 bp, synthetic construct
  misc_feature 1..20: note = Synthetic oligonucleotide
  source 1..20: mol_type = other DNA
ttgtgatatttaacaatgta

SEQ ID NO: 1623 - DNA, 20 bp, synthetic construct
  misc_feature 1..20: note = Synthetic oligonucleotide
  source 1..20: mol_type = other DNA
aaaatcaaaataattactca

SEQ ID NO: 1624 - DNA, 20 bp, synthetic construct
  misc_feature 1..20: note = Synthetic oligonucleotide
  source 1..20: mol_type = other DNA
acctttttcctaaagccaaa

SEQ ID NO: 1625 - DNA, 20 bp, synthetic construct
  misc_feature 1..20: note = Synthetic oligonucleotide
  source 1..20: mol_type = other DNA
ataatcctaatatctttgtc

SEQ ID NO: 1626 - DNA, 20 bp, synthetic construct
  misc_feature 1..20: note = Synthetic oligonucleotide
  source 1..20: mol_type = other DNA
gtttgctttaaatctggcca

SEQ ID NO: 1627 - DNA, 20 bp, synthetic construct
  misc_feature 1..20: note = Synthetic oligonucleotide
  source 1..20: mol_type = other DNA
tggaatgcatcctctagtaa

SEQ ID NO: 1628 - DNA, 20 bp, synthetic construct
  misc_feature 1..20: note = Synthetic oligonucleotide
  source 1..20: mol_type = other DNA
atgtaattcttcaatagctt

SEQ ID NO: 1629 - DNA, 20 bp, synthetic construct
  misc_feature 1..20: note = Synthetic oligonucleotide
  source 1..20: mol_type = other DNA
ttaaacattattaaaagaac

SEQ ID NO: 1630 - DNA, 20 bp, synthetic construct
  misc_feature 1..20: note = Synthetic oligonucleotide
  source 1..20: mol_type = other DNA
ctgatgcaatttactaatta

SEQ ID NO: 1631 - DNA, 20 bp, synthetic construct
  misc_feature 1..20: note = Synthetic oligonucleotide
  source 1..20: mol_type = other DNA
tctttgaacccagttttttc

SEQ ID NO: 1632 - DNA, 20 bp, synthetic construct
  misc_feature 1..20: note = Synthetic oligonucleotide
  source 1..20: mol_type = other DNA
ccctcttttcctgtgtttca

SEQ ID NO: 1633 - DNA, 20 bp, synthetic construct
  misc_feature 1..20: note = Synthetic oligonucleotide
  source 1..20: mol_type = other DNA
gtcttaattttaatatcacc

SEQ ID NO: 1634 - DNA, 20 bp, synthetic construct
  misc_feature 1..20: note = Synthetic oligonucleotide
  source 1..20: mol_type = other DNA
gtacaagactattctaccaa

SEQ ID NO: 1635 - DNA, 20 bp, synthetic construct
  misc_feature 1..20: note = Synthetic oligonucleotide
  source 1..20: mol_type = other DNA
tataacagtctccaatgcaa

SEQ ID NO: 1636 - DNA, 20 bp, synthetic construct
  misc_feature 1..20: note = Synthetic oligonucleotide
  source 1..20: mol_type = other DNA
cgagagattgctttcccttt

SEQ ID NO: 1637 - DNA, 20 bp, synthetic construct
  misc_feature 1..20: note = Synthetic oligonucleotide
  source 1..20: mol_type = other DNA
aagtagtaccattcccatcc

SEQ ID NO: 1638 - DNA, 20 bp, synthetic construct
  misc_feature 1..20: note = Synthetic oligonucleotide
  source 1..20: mol_type = other DNA
gactctgtcatttttctctt

SEQ ID NO: 1639 - DNA, 20 bp, synthetic construct
  misc_feature 1..20: note = Synthetic oligonucleotide
  source 1..20: mol_type = other DNA
atattagcaaatttatacca

SEQ ID NO: 1640 - DNA, 20 bp, synthetic construct
  misc_feature 1..20: note = Synthetic oligonucleotide
  source 1..20: mol_type = other DNA
gggagttcacaatcattgga

SEQ ID NO: 1641 - DNA, 20 bp, synthetic construct
  misc_feature 1..20: note = Synthetic oligonucleotide
  source 1..20: mol_type = other DNA
cctcaaattccaccagagtt

SEQ ID NO: 1642 - DNA, 20 bp, synthetic construct
  misc_feature 1..20: note = Synthetic oligonucleotide
  source 1..20: mol_type = other DNA
gtgtaattaatacaatggta

SEQ ID NO: 1643 - DNA, 20 bp, synthetic construct
  misc_feature 1..20: note = Synthetic oligonucleotide
  source 1..20: mol_type = other DNA
gtaatgggctcataagagac

SEQ ID NO: 1644 - DNA, 20 bp, synthetic construct
  misc_feature 1..20: note = Synthetic oligonucleotide
  source 1..20: mol_type = other DNA
ttgacacaaacacatcacca

SEQ ID NO: 1645 - DNA, 20 bp, synthetic construct
  misc_feature 1..20: note = Synthetic oligonucleotide
  source 1..20: mol_type = other DNA
cacttatcaaaaatgtgata

SEQ ID NO: 1646 - DNA, 20 bp, synthetic construct
  misc_feature 1..20: note = Synthetic oligonucleotide
  source 1..20: mol_type = other DNA
aaattgacatatactatgtc

SEQ ID NO: 1647 - DNA, 20 bp, synthetic construct
  misc_feature 1..20: note = Synthetic oligonucleotide
  source 1..20: mol_type = other DNA
agcttgcaaactatacttac

SEQ ID NO: 1648 - DNA, 20 bp, synthetic construct
  misc_feature 1..20: note = Synthetic oligonucleotide
  source 1..20: mol_type = other DNA
ttgcttcactttaccactga

SEQ ID NO: 1649 - DNA, 20 bp, synthetic construct
  misc_feature 1..20: note = Synthetic oligonucleotide
  source 1..20: mol_type = other DNA
cagaaactaacaatagtgac

SEQ ID NO: 1650 - DNA, 20 bp, synthetic construct
  misc_feature 1..20: note = Synthetic oligonucleotide
  source 1..20: mol_type = other DNA
atcccatattatatctgata

SEQ ID NO: 1651 - DNA, 20 bp, synthetic construct
  misc_feature 1..20: note = Synthetic oligonucleotide
  source 1..20: mol_type = other DNA
tgcatttcaccaacacacta

SEQ ID NO: 1652 - DNA, 20 bp, synthetic construct
  misc_feature 1..20: note = Synthetic oligonucleotide
  source 1..20: mol_type = other DNA
ttatttttacatgatagaaa

SEQ ID NO: 1653 - DNA, 20 bp, synthetic construct
  misc_feature 1..20: note = Synthetic oligonucleotide
  source 1..20: mol_type = other DNA
agttatccaatacactcttc

SEQ ID NO: 1654 - DNA, 20 bp, synthetic construct
  misc_feature 1..20: note = Synthetic oligonucleotide
  source 1..20: mol_type = other DNA
ctgttattctaataataatc

SEQ ID NO: 1655 - DNA, 20 bp, synthetic construct
  misc_feature 1..20: note = Synthetic oligonucleotide
  source 1..20: mol_type = other DNA
aacctgtttttaaataggtg

SEQ ID NO: 1656 - DNA, 20 bp, synthetic construct
  misc_feature 1..20: note = Synthetic oligonucleotide
  source 1..20: mol_type = other DNA
gtttgattttataacactaa

SEQ ID NO: 1657 - DNA, 20 bp, synthetic construct
  misc_feature 1..20: note = Synthetic oligonucleotide
  source 1..20: mol_type = other DNA
gttttgttcatcttaaattt

SEQ ID NO: 1658 - DNA, 20 bp, synthetic construct
  misc_feature 1..20: note = Synthetic oligonucleotide
  source 1..20: mol_type = other DNA
gttaaaccatagagccatat

SEQ ID NO: 1659 - DNA, 20 bp, synthetic construct
  misc_feature 1..20: note = Synthetic oligonucleotide
  source 1..20: mol_type = other DNA
tactcatcttcatcttcttt

SEQ ID NO: 1660 - DNA, 20 bp, synthetic construct
  misc_feature 1..20: note = Synthetic oligonucleotide
  source 1..20: mol_type = other DNA
attataaattatcaatgtta

SEQ ID NO: 1661 - DNA, 20 bp, synthetic construct
  misc_feature 1..20: note = Synthetic oligonucleotide
  source 1..20: mol_type = other DNA
ccaaaatgtttatttagcat

SEQ ID NO: 1662 - DNA, 20 bp, synthetic construct
  misc_feature 1..20: note = Synthetic oligonucleotide
  source 1..20: mol_type = other DNA
ttaatattattaaatatcaa

SEQ ID NO: 1663 - DNA, 20 bp, synthetic construct
  misc_feature 1..20: note = Synthetic oligonucleotide
  source 1..20: mol_type = other DNA
gtttaaatctcaaatacatt

SEQ ID NO: 1664 - DNA, 20 bp, synthetic construct
  misc_feature 1..20: note = Synthetic oligonucleotide
  source 1..20: mol_type = other DNA
ggtgaaaaaccttacagcca

SEQ ID NO: 1665 - DNA, 20 bp, synthetic construct
  misc_feature 1..20: note = Synthetic oligonucleotide
  source 1..20: mol_type = other DNA
caattgttccatctttgtca

SEQ ID NO: 1666 - DNA, 20 bp, synthetic construct
  misc_feature 1..20: note = Synthetic oligonucleotide
  source 1..20: mol_type = other DNA
gtgtcaacttcaattatcaa

SEQ ID NO: 1667 - DNA, 20 bp, synthetic construct
  misc_feature 1..20: note = Synthetic oligonucleotide
  source 1..20: mol_type = other DNA
tagctcaataacttggtcaa

SEQ ID NO: 1668 - DNA, 20 bp, synthetic construct
  misc_feature 1..20: note = Synthetic oligonucleotide
  source 1..20: mol_type = other DNA
taatagatcataatttataa

SEQ ID NO: 1669 - DNA, 20 bp, synthetic construct
  misc_feature 1..20: note = Synthetic oligonucleotide
  source 1..20: mol_type = other DNA
acatctgaaatataacactt

SEQ ID NO: 1670 - DNA, 20 bp, synthetic construct
  misc_feature 1..20: note = Synthetic oligonucleotide
  source 1..20: mol_type = other DNA
tttcttcttccaaacacaca

SEQ ID NO: 1671 - DNA, 20 bp, synthetic construct
  misc_feature 1..20: note = Synthetic oligonucleotide
  source 1..20: mol_type = other DNA
cagtgcatatttctgagcca

SEQ ID NO: 1672 - DNA, 20 bp, synthetic construct
  misc_feature 1..20: note = Synthetic oligonucleotide
  source 1..20: mol_type = other DNA
tagggtcaagtttttacgct

SEQ ID NO: 1673 - DNA, 20 bp, synthetic construct
  misc_feature 1..20: note = Synthetic oligonucleotide
  source 1..20: mol_type = other DNA
atgatgatcttctcaactac

SEQ ID NO: 1674 - DNA, 20 bp, synthetic construct
  misc_feature 1..20: note = Synthetic oligonucleotide
  source 1..20: mol_type = other DNA
atctacccctccattcctgc

SEQ ID NO: 1675 - DNA, 20 bp, synthetic construct
  misc_feature 1..20: note = Synthetic oligonucleotide
  source 1..20: mol_type = other DNA
aatattctccactttcctcc

SEQ ID NO: 1676 - DNA, 20 bp, synthetic construct
  misc_feature 1..20: note = Synthetic oligonucleotide
  source 1..20: mol_type = other DNA
ctccttcaacttaatggccc

SEQ ID NO: 1677 - DNA, 20 bp, synthetic construct
  misc_feature 1..20: note = Synthetic oligonucleotide
  source 1..20: mol_type = other DNA
atgcactaccatgccttcac

SEQ ID NO: 1678 - DNA, 20 bp, synthetic construct
  misc_feature 1..20: note = Synthetic oligonucleotide
  source 1..20: mol_type = other DNA
atcttacttttatcctcaat

SEQ ID NO: 1679 - DNA, 20 bp, synthetic construct
  misc_feature 1..20: note = Synthetic oligonucleotide
  source 1..20: mol_type = other DNA
aaccaaatagggccaaatta

SEQ ID NO: 1680 - DNA, 20 bp, synthetic construct
  misc_feature 1..20: note = Synthetic oligonucleotide
  source 1..20: mol_type = other DNA
agatttttcacaatattgaa

SEQ ID NO: 1681 - DNA, 20 bp, synthetic construct
  misc_feature 1..20: note = Synthetic oligonucleotide
  source 1..20: mol_type = other DNA
catgatcccaataataacaa

SEQ ID NO: 1682 - DNA, 20 bp, synthetic construct
  misc_feature 1..20: note = Synthetic oligonucleotide
  source 1..20: mol_type = other DNA
aagtaataacttcttaataa

SEQ ID NO: 1683 - DNA, 20 bp, synthetic construct
  misc_feature 1..20: note = Synthetic oligonucleotide
  source 1..20: mol_type = other DNA
atttgaataccaacaaccct

SEQ ID NO: 1684 - DNA, 20 bp, synthetic construct
  misc_feature 1..20: note = Synthetic oligonucleotide
  source 1..20: mol_type = other DNA
cttatcacaaataaataata

SEQ ID NO: 1685 - DNA, 20 bp, synthetic construct
  misc_feature 1..20: note = Synthetic oligonucleotide
  source 1..20: mol_type = other DNA
ataatagaatccatgagtta

SEQ ID NO: 1686 - DNA, 20 bp, synthetic construct
  misc_feature 1..20: note = Synthetic oligonucleotide
  source 1..20: mol_type = other DNA
aagtcacaaattaacacatt

SEQ ID NO: 1687 - DNA, 20 bp, synthetic construct
  misc_feature 1..20: note = Synthetic oligonucleotide
  source 1..20: mol_type = other DNA
gggttatccacatagaatca

SEQ ID NO: 1688 - DNA, 20 bp, synthetic construct
  misc_feature 1..20: note = Synthetic oligonucleotide
  source 1..20: mol_type = other DNA
atttccactaaaaatagatt

SEQ ID NO: 1689 - DNA, 20 bp, synthetic construct
  misc_feature 1..20: note = Synthetic oligonucleotide
  source 1..20: mol_type = other DNA
tacatataattcatacattt

SEQ ID NO: 1690 - DNA, 20 bp, synthetic construct
  misc_feature 1..20: note = Synthetic oligonucleotide
  source 1..20: mol_type = other DNA
tctaaatttaatattgctaa

SEQ ID NO: 1691 - DNA, 20 bp, synthetic construct
  misc_feature 1..20: note = Synthetic oligonucleotide
  source 1..20: mol_type = other DNA
gtgtctttcctctttttttc

SEQ ID NO: 1692 - DNA, 20 bp, synthetic construct
  misc_feature 1..20: note = Synthetic oligonucleotide
  source 1..20: mol_type = other DNA
gttcaattccattctttcat

SEQ ID NO: 1693 - DNA, 20 bp, synthetic construct
  misc_feature 1..20: note = Synthetic oligonucleotide
  source 1..20: mol_type = other DNA
ttttttcctttaaattgctc

SEQ ID NO: 1694 - DNA, 20 bp, synthetic construct
  misc_feature 1..20: note = Synthetic oligonucleotide
  source 1..20: mol_type = other DNA
aaacacttcctttcttctat

SEQ ID NO: 1695 - DNA, 20 bp, synthetic construct
  misc_feature 1..20: note = Synthetic oligonucleotide
  source 1..20: mol_type = other DNA
tgaagactaattaattacaa

SEQ ID NO: 1696 - DNA, 20 bp, synthetic construct
  misc_feature 1..20: note = Synthetic oligonucleotide
  source 1..20: mol_type = other DNA
gatgaattatttatttgtca

SEQ ID NO: 1697 - DNA, 20 bp, synthetic construct
  misc_feature 1..20: note = Synthetic oligonucleotide
  source 1..20: mol_type = other DNA
atatatgactaccttagcta

SEQ ID NO: 1698 - DNA, 20 bp, synthetic construct
  misc_feature 1..20: note = Synthetic oligonucleotide
  source 1..20: mol_type = other DNA
ttgctttccatcattagttt

SEQ ID NO: 1699 - DNA, 20 bp, synthetic construct
  misc_feature 1..20: note = Synthetic oligonucleotide
  source 1..20: mol_type = other DNA
aaggaattacattaatataa

SEQ ID NO: 1700 - DNA, 20 bp, synthetic construct
  misc_feature 1..20: note = Synthetic oligonucleotide
  source 1..20: mol_type = other DNA
acataacttcctattaaatt

SEQ ID NO: 1701 - DNA, 20 bp, synthetic construct
  misc_feature 1..20: note = Synthetic oligonucleotide
  source 1..20: mol_type = other DNA
tcttatttaaatcacattaa

SEQ ID NO: 1702 - DNA, 20 bp, synthetic construct
  misc_feature 1..20: note = Synthetic oligonucleotide
  source 1..20: mol_type = other DNA
tttcttattttaatttatca

SEQ ID NO: 1703 - DNA, 20 bp, synthetic construct
  misc_feature 1..20: note = Synthetic oligonucleotide
  source 1..20: mol_type = other DNA
actatttcccatctttatta

SEQ ID NO: 1704 - DNA, 20 bp, synthetic construct
  misc_feature 1..20: note = Synthetic oligonucleotide
  source 1..20: mol_type = other DNA
atgatttcttaaaaaaggaa

SEQ ID NO: 1705 - DNA, 20 bp, synthetic construct
  misc_feature 1..20: note = Synthetic oligonucleotide
  source 1..20: mol_type = other DNA
ctgctctcaataataattct

SEQ ID NO: 1706 - DNA, 20 bp, synthetic construct
  misc_feature 1..20: note = Synthetic oligonucleotide
  source 1..20: mol_type = other DNA
caacaacaaatatttactta

SEQ ID NO: 1707 - DNA, 20 bp, synthetic construct
  misc_feature 1..20: note = Synthetic oligonucleotide
  source 1..20: mol_type = other DNA
ttaactttctcaaataatgt

SEQ ID NO: 1708 - DNA, 20 bp, synthetic construct
  misc_feature 1..20: note = Synthetic oligonucleotide
  source 1..20: mol_type = other DNA
gtttctttgaacccagtttt

SEQ ID NO: 1709 - DNA, 20 bp, synthetic construct
  misc_feature 1..20: note = Synthetic oligonucleotide
  source 1..20: mol_type = other DNA
cctccctcttttcctgtgtt

SEQ ID NO: 1710 - DNA, 20 bp, synthetic construct
  misc_feature 1..20: note = Synthetic oligonucleotide
  source 1..20: mol_type = other DNA
cttacttccaccctctgata

SEQ ID NO: 1711 - DNA, 20 bp, synthetic construct
  misc_feature 1..20: note = Synthetic oligonucleotide
  source 1..20: mol_type = other DNA
ctcatttaatatcttataca

SEQ ID NO: 1712 - DNA, 20 bp, synthetic construct
  misc_feature 1..20: note = Synthetic oligonucleotide
  source 1..20: mol_type = other DNA
ttgaatataacagtctccaa

SEQ ID NO: 1713 - DNA, 20 bp, synthetic construct
  misc_feature 1..20: note = Synthetic oligonucleotide
  source 1..20: mol_type = other DNA
tcgagagattgctttccctt

SEQ ID NO: 1714 - DNA, 20 bp, synthetic construct
  misc_feature 1..20: note = Synthetic oligonucleotide
  source 1..20: mol_type = other DNA
aaagtagtaccattcccatc

SEQ ID NO: 1715 - DNA, 20 bp, synthetic construct
  misc_feature 1..20: note = Synthetic oligonucleotide
  source 1..20: mol_type = other DNA
cggactctgtcatttttctc

SEQ ID NO: 1716 - DNA, 20 bp, synthetic construct
  misc_feature 1..20: note = Synthetic oligonucleotide
  source 1..20: mol_type = other DNA
aatcaaacacatattagcaa

SEQ ID NO: 1717 - DNA, 20 bp, synthetic construct
  misc_feature 1..20: note = Synthetic oligonucleotide
  source 1..20: mol_type = other DNA
ctgcatccttcccacagcaa

SEQ ID NO: 1718 - DNA, 20 bp, synthetic construct
  misc_feature 1..20: note = Synthetic oligonucleotide
  source 1..20: mol_type = other DNA
gttttcctcaaattccacca

SEQ ID NO: 1719 - DNA, 20 bp, synthetic construct
  misc_feature 1..20: note = Synthetic oligonucleotide
  source 1..20: mol_type = other DNA
ggtgtaattaatacaatggt

SEQ ID NO: 1720 - DNA, 20 bp, synthetic construct
  misc_feature 1..20: note = Synthetic oligonucleotide
  source 1..20: mol_type = other DNA
actttttgcttcaagaggta

SEQ ID NO: 1721 - DNA, 20 bp, synthetic construct
  misc_feature 1..20: note = Synthetic oligonucleotide
  source 1..20: mol_type = other DNA
ccttaagtatacatttgtaa

SEQ ID NO: 1722 - DNA, 20 bp, synthetic construct
  misc_feature 1..20: note = Synthetic oligonucleotide
  source 1..20: mol_type = other DNA
gacacttatcaaaaatgtga

SEQ ID NO: 1723 - DNA, 20 bp, synthetic construct
  misc_feature 1..20: note = Synthetic oligonucleotide
  source 1..20: mol_type = other DNA
ttttaaattgacatatacta

SEQ ID NO: 1724 - DNA, 20 bp, synthetic construct
  misc_feature 1..20: note = Synthetic oligonucleotide
  source 1..20: mol_type = other DNA
aagcttgcaaactatactta

SEQ ID NO: 1725 - DNA, 20 bp, synthetic construct
  misc_feature 1..20: note = Synthetic oligonucleotide
  source 1..20: mol_type = other DNA
atttgcttcactttaccact

SEQ ID NO: 1726 - DNA, 20 bp, synthetic construct
  misc_feature 1..20: note = Synthetic oligonucleotide
  source 1..20: mol_type = other DNA
acagaaactaacaatagtga

SEQ ID NO: 1727 - DNA, 20 bp, synthetic construct
  misc_feature 1..20: note = Synthetic oligonucleotide
  source 1..20: mol_type = other DNA
tgggatcccatattatatct

SEQ ID NO: 1728 - DNA, 20 bp, synthetic construct
  misc_feature 1..20: note = Synthetic oligonucleotide
  source 1..20: mol_type = other DNA
atgcatttcaccaacacact

SEQ ID NO: 1729 - DNA, 20 bp, synthetic construct
  misc_feature 1..20: note = Synthetic oligonucleotide
  source 1..20: mol_type = other DNA
tagattatttttacatgata

SEQ ID NO: 1730 - DNA, 20 bp, synthetic construct
  misc_feature 1..20: note = Synthetic oligonucleotide
  source 1..20: mol_type = other DNA
tagttatccaatacactctt

SEQ ID NO: 1731 - DNA, 20 bp, synthetic construct
  misc_feature 1..20: note = Synthetic oligonucleotide
  source 1..20: mol_type = other DNA
aggcatttaaaaacaatctt

SEQ ID NO: 1732 - DNA, 20 bp, synthetic construct
  misc_feature 1..20: note = Synthetic oligonucleotide
  source 1..20: mol_type = other DNA
ttatcttttcctaatagaaa

SEQ ID NO: 1733 - DNA, 20 bp, synthetic construct
  misc_feature 1..20: note = Synthetic oligonucleotide
  source 1..20: mol_type = other DNA
ttggtgatttatataaacta

SEQ ID NO: 1734 - DNA, 20 bp, synthetic construct
  misc_feature 1..20: note = Synthetic oligonucleotide
  source 1..20: mol_type = other DNA
tgctcttttttaaataaaaa

SEQ ID NO: 1735 - DNA, 20 bp, synthetic construct
  misc_feature 1..20: note = Synthetic oligonucleotide
  source 1..20: mol_type = other DNA
agttaaaccatagagccata

SEQ ID NO: 1736 - DNA, 20 bp, synthetic construct
  misc_feature 1..20: note = Synthetic oligonucleotide
  source 1..20: mol_type = other DNA
gatttattttttacctatta

SEQ ID NO: 1737 - DNA, 20 bp, synthetic construct
  misc_feature 1..20: note = Synthetic oligonucleotide
  source 1..20: mol_type = other DNA
ttaaatattataaattatca

SEQ ID NO: 1738 - DNA, 20 bp, synthetic construct
  misc_feature 1..20: note = Synthetic oligonucleotide
  source 1..20: mol_type = other DNA
tagactattttcactagtac

SEQ ID NO: 1739 - DNA, 20 bp, synthetic construct
  misc_feature 1..20: note = Synthetic oligonucleotide
  source 1..20: mol_type = other DNA
tcttctttttcttaatatta

SEQ ID NO: 1740 - DNA, 20 bp, synthetic construct
  misc_feature 1..20: note = Synthetic oligonucleotide
  source 1..20: mol_type = other DNA
gcagtttaaatctcaaatac

SEQ ID NO: 1741 - DNA, 20 bp, synthetic construct
  misc_feature 1..20: note = Synthetic oligonucleotide
  source 1..20: mol_type = other DNA
tttatgtattcaacaaataa

SEQ ID NO: 1742 - DNA, 20 bp, synthetic construct
  misc_feature 1..20: note = Synthetic oligonucleotide
  source 1..20: mol_type = other DNA
ctgaaagtttccttttccta

SEQ ID NO: 1743 - DNA, 20 bp, synthetic construct
  misc_feature 1..20: note = Synthetic oligonucleotide
  source 1..20: mol_type = other DNA
caatatttcataaatctcta

SEQ ID NO: 1744 - DNA, 20 bp, synthetic construct
  misc_feature 1..20: note = Synthetic oligonucleotide
  source 1..20: mol_type = other DNA
gtagctcaataacttggtca

SEQ ID NO: 1745 - DNA, 20 bp, synthetic construct
  misc_feature 1..20: note = Synthetic oligonucleotide
  source 1..20: mol_type = other DNA
ataatagatcataatttata

SEQ ID NO: 1746 - DNA, 20 bp, synthetic construct
  misc_feature 1..20: note = Synthetic oligonucleotide
  source 1..20: mol_type = other DNA
cttttgttatatctctgctc

SEQ ID NO: 1747 - DNA, 20 bp, synthetic construct
  misc_feature 1..20: note = Synthetic oligonucleotide
  source 1..20: mol_type = other DNA
gtaacacttatcactagctc

SEQ ID NO: 1748 - DNA, 20 bp, synthetic construct
  misc_feature 1..20: note = Synthetic oligonucleotide
  source 1..20: mol_type = other DNA
gaggagtttttaacctatat

SEQ ID NO: 1749 - DNA, 20 bp, synthetic construct
  misc_feature 1..20: note = Synthetic oligonucleotide
  source 1..20: mol_type = other DNA
actagggtcaagtttttacg

SEQ ID NO: 1750 - DNA, 20 bp, synthetic construct
  misc_feature 1..20: note = Synthetic oligonucleotide
  source 1..20: mol_type = other DNA
aatgatgatcttctcaacta

SEQ ID NO: 1751 - DNA, 20 bp, synthetic construct
  misc_feature 1..20: note = Synthetic oligonucleotide
  source 1..20: mol_type = other DNA
atcttttaatctacccctcc

SEQ ID NO: 1752 - DNA, 20 bp, synthetic construct
  misc_feature 1..20: note = Synthetic oligonucleotide
  source 1..20: mol_type = other DNA
ctgtattttcctactaggct

SEQ ID NO: 1753 - DNA, 20 bp, synthetic construct
  misc_feature 1..20: note = Synthetic oligonucleotide
  source 1..20: mol_type = other DNA
gtaagtctccttcaacttaa

SEQ ID NO: 1754 - DNA, 20 bp, synthetic construct
  misc_feature 1..20: note = Synthetic oligonucleotide
  source 1..20: mol_type = other DNA
tatgcactaccatgccttca

SEQ ID NO: 1755 - DNA, 20 bp, synthetic construct
  misc_feature 1..20: note = Synthetic oligonucleotide
  source 1..20: mol_type = other DNA
actaaacaacttaatggttt

SEQ ID NO: 1756 - DNA, 20 bp, synthetic construct
  misc_feature 1..20: note = Synthetic oligonucleotide
  source 1..20: mol_type = other DNA
tcaaccaaatagggccaaat

SEQ ID NO: 1757 - DNA, 20 bp, synthetic construct
  misc_feature 1..20: note = Synthetic oligonucleotide
  source 1..20: mol_type = other DNA
gataaactaataaatatata

SEQ ID NO: 1758 - DNA, 20 bp, synthetic construct
  misc_feature 1..20: note = Synthetic oligonucleotide
  source 1..20: mol_type = other DNA
gcatgatcccaataataaca

SEQ ID NO: 1759 - DNA, 20 bp, synthetic construct
  misc_feature 1..20: note = Synthetic oligonucleotide
  source 1..20: mol_type = other DNA
aataaagtaataacttctta

SEQ ID NO: 1760 - DNA, 20 bp, synthetic construct
  misc_feature 1..20: note = Synthetic oligonucleotide
  source 1..20: mol_type = other DNA
tcttcataggcaacttgata

SEQ ID NO: 1761 - DNA, 20 bp, synthetic construct
  misc_feature 1..20: note = Synthetic oligonucleotide
  source 1..20: mol_type = other DNA
tagcttatcacaaataaata

SEQ ID NO: 1762 - DNA, 20 bp, synthetic construct
  misc_feature 1..20: note = Synthetic oligonucleotide
  source 1..20: mol_type = other DNA
gaggctaaatataaaaaaaa

SEQ ID NO: 1763 - DNA, 20 bp, synthetic construct
  misc_feature 1..20: note = Synthetic oligonucleotide
  source 1..20: mol_type = other DNA
aaagtcacaaattaacacat

SEQ ID NO: 1764 - DNA, 20 bp, synthetic construct
  misc_feature 1..20: note = Synthetic oligonucleotide
  source 1..20: mol_type = other DNA
gccacatctccattattcct

SEQ ID NO: 1765 - DNA, 20 bp, synthetic construct
  misc_feature 1..20: note = Synthetic oligonucleotide
  source 1..20: mol_type = other DNA
attgtttttaaaatttccac

SEQ ID NO: 1766 - DNA, 20 bp, synthetic construct
  misc_feature 1..20: note = Synthetic oligonucleotide
  source 1..20: mol_type = other DNA
atacatataattcatacatt

SEQ ID NO: 1767 - DNA, 20 bp, synthetic construct
  misc_feature 1..20: note = Synthetic oligonucleotide
  source 1..20: mol_type = other DNA
ttctaaatttaatattgcta

SEQ ID NO: 1768 - DNA, 20 bp, synthetic construct
  misc_feature 1..20: note = Synthetic oligonucleotide
  source 1..20: mol_type = other DNA
ctacttctaataattagtgt

SEQ ID NO: 1769 - DNA, 20 bp, synthetic construct
  misc_feature 1..20: note = Synthetic oligonucleotide
  source 1..20: mol_type = other DNA
cttaatttttatatatgtta

SEQ ID NO: 1770 - DNA, 20 bp, synthetic construct
  misc_feature 1..20: note = Synthetic oligonucleotide
  source 1..20: mol_type = other DNA
tgtgtacttttcaattataa

SEQ ID NO: 1771 - DNA, 20 bp, synthetic construct
  misc_feature 1..20: note = Synthetic oligonucleotide
  source 1..20: mol_type = other DNA
gtctgttttccaataaattt

SEQ ID NO: 1772 - DNA, 20 bp, synthetic construct
  misc_feature 1..20: note = Synthetic oligonucleotide
  source 1..20: mol_type = other DNA
gtgtattcaaataatattat

SEQ ID NO: 1773 - DNA, 20 bp, synthetic construct
  misc_feature 1..20: note = Synthetic oligonucleotide
  source 1..20: mol_type = other DNA
gtaattttattaacagggca

SEQ ID NO: 1774 - DNA, 20 bp, synthetic construct
  misc_feature 1..20: note = Synthetic oligonucleotide
  source 1..20: mol_type = other DNA
gacacctttcccatttttcc

SEQ ID NO: 1775 - DNA, 20 bp, synthetic construct
  misc_feature 1..20: note = Synthetic oligonucleotide
  source 1..20: mol_type = other DNA
tcaaaacattctattgcttc

SEQ ID NO: 1776 - DNA, 20 bp, synthetic construct
  misc_feature 1..20: note = Synthetic oligonucleotide
  source 1..20: mol_type = other DNA
aacaatcattcaaaatcaca

SEQ ID NO: 1777 - DNA, 20 bp, synthetic construct
  misc_feature 1..20: note = Synthetic oligonucleotide
  source 1..20: mol_type = other DNA
tttctgctttaataatacta

SEQ ID NO: 1778 - DNA, 20 bp, synthetic construct
  misc_feature 1..20: note = Synthetic oligonucleotide
  source 1..20: mol_type = other DNA
tttctcttatttaaatcaca

SEQ ID NO: 1779 - DNA, 20 bp, synthetic construct
  misc_feature 1..20: note = Synthetic oligonucleotide
  source 1..20: mol_type = other DNA
atttcttattttaatttatc

SEQ ID NO: 1780 - DNA, 20 bp, synthetic construct
  misc_feature 1..20: note = Synthetic oligonucleotide
  source 1..20: mol_type = other DNA
gttggtatttccatcctgtc

SEQ ID NO: 1781 - DNA, 20 bp, synthetic construct
  misc_feature 1..20: note = Synthetic oligonucleotide
  source 1..20: mol_type = other DNA
gatgatttcttaaaaaagga

SEQ ID NO: 1782 - DNA, 20 bp, synthetic construct
  misc_feature 1..20: note = Synthetic oligonucleotide
  source 1..20: mol_type = other DNA
agtctgctctcaataataat

SEQ ID NO: 1783 - DNA, 20 bp, synthetic construct
  misc_feature 1..20: note = Synthetic oligonucleotide
  source 1..20: mol_type = other DNA
aagtgattacttactacttg

SEQ ID NO: 1784 - DNA, 20 bp, synthetic construct
  misc_feature 1..20: note = Synthetic oligonucleotide
  source 1..20: mol_type = other DNA
tctttaactttctcaaataa

SEQ ID NO: 1785 - DNA, 20 bp, synthetic construct
  misc_feature 1..20: note = Synthetic oligonucleotide
  source 1..20: mol_type = other DNA
ggtttctttgaacccagttt

SEQ ID NO: 1786 - DNA, 20 bp, synthetic construct
  misc_feature 1..20: note = Synthetic oligonucleotide
  source 1..20: mol_type = other DNA
tcctccctcttttcctgtgt

SEQ ID NO: 1787 - DNA, 20 bp, synthetic construct
  misc_feature 1..20: note = Synthetic oligonucleotide
  source 1..20: mol_type = other DNA
aactagatttctattactcc

SEQ ID NO: 1788 - DNA, 20 bp, synthetic construct
  misc_feature 1..20: note = Synthetic oligonucleotide
  source 1..20: mol_type = other DNA
cctcatttaatatcttatac

SEQ ID NO: 1789 - DNA, 20 bp, synthetic construct
  misc_feature 1..20: note = Synthetic oligonucleotide
  source 1..20: mol_type = other DNA
gtgttgaatataacagtctc

SEQ ID NO: 1790 - DNA, 20 bp, synthetic construct
  misc_feature 1..20: note = Synthetic oligonucleotide
  source 1..20: mol_type = other DNA
aatcgagagattgctttccc

SEQ ID NO: 1791 - DNA, 20 bp, synthetic construct
  misc_feature 1..20: note = Synthetic oligonucleotide
  source 1..20: mol_type = other DNA
gaaagtagtaccattcccat

SEQ ID NO: 1792 - DNA, 20 bp, synthetic construct
  misc_feature 1..20: note = Synthetic oligonucleotide
  source 1..20: mol_type = other DNA
aaaccttttcttcttatgct

SEQ ID NO: 1793 - DNA, 20 bp, synthetic construct
  misc_feature 1..20: note = Synthetic oligonucleotide
  source 1..20: mol_type = other DNA
aaatcaaacacatattagca

SEQ ID NO: 1794 - DNA, 20 bp, synthetic construct
  misc_feature 1..20: note = Synthetic oligonucleotide
  source 1..20: mol_type = other DNA
atcgattcctttctgcatcc

SEQ ID NO: 1795 - DNA, 20 bp, synthetic construct
  misc_feature 1..20: note = Synthetic oligonucleotide
  source 1..20: mol_type = other DNA
tgttttcctcaaattccacc

SEQ ID NO: 1796 - DNA, 20 bp, synthetic construct
  misc_feature 1..20: note = Synthetic oligonucleotide
  source 1..20: mol_type = other DNA
acatcaaacatctctccagt

SEQ ID NO: 1797 - DNA, 20 bp, synthetic construct
  misc_feature 1..20: note = Synthetic oligonucleotide
  source 1..20: mol_type = other DNA
cctttttaactttttgcttc

SEQ ID NO: 1798 - DNA, 20 bp, synthetic construct
  misc_feature 1..20: note = Synthetic oligonucleotide
  source 1..20: mol_type = other DNA
ctatttctccagtttactga

SEQ ID NO: 1799 - DNA, 20 bp, synthetic construct
  misc_feature 1..20: note = Synthetic oligonucleotide
  source 1..20: mol_type = other DNA
ggacacttatcaaaaatgtg

SEQ ID NO: 1800 - DNA, 20 bp, synthetic construct
  misc_feature 1..20: note = Synthetic oligonucleotide
  source 1..20: mol_type = other DNA
agcagacttttattttttaa

SEQ ID NO: 1801 - DNA, 20 bp, synthetic construct
  misc_feature 1..20: note = Synthetic oligonucleotide
  source 1..20: mol_type = other DNA
ttacatcatattacctgttg

SEQ ID NO: 1802 - DNA, 20 bp, synthetic construct
  misc_feature 1..20: note = Synthetic oligonucleotide
  source 1..20: mol_type = other DNA
aatttgcttcactttaccac

SEQ ID NO: 1803 - DNA, 20 bp, synthetic construct
  misc_feature 1..20: note = Synthetic oligonucleotide
  source 1..20: mol_type = other DNA
aggaacagaaactaacaata

SEQ ID NO: 1804 - DNA, 20 bp, synthetic construct
  misc_feature 1..20: note = Synthetic oligonucleotide
  source 1..20: mol_type = other DNA
ctgggatcccatattatatc

SEQ ID NO: 1805 - DNA, 20 bp, synthetic construct
  misc_feature 1..20: note = Synthetic oligonucleotide
  source 1..20: mol_type = other DNA
catgcatttcaccaacacac

SEQ ID NO: 1806 - DNA, 20 bp, synthetic construct
  misc_feature 1..20: note = Synthetic oligonucleotide
  source 1..20: mol_type = other DNA
tttgtttttcagatagatta

SEQ ID NO: 1807 - DNA, 20 bp, synthetic construct
  misc_feature 1..20: note = Synthetic oligonucleotide
  source 1..20: mol_type = other DNA
ttttataaaatcattcccca

SEQ ID NO: 1808 - DNA, 20 bp, synthetic construct
  misc_feature 1..20: note = Synthetic oligonucleotide
  source 1..20: mol_type = other DNA
ctttccttttctatttattt

SEQ ID NO: 1809 - DNA, 20 bp, synthetic construct
  misc_feature 1..20: note = Synthetic oligonucleotide
  source 1..20: mol_type = other DNA
gagagctattttaataggtc

SEQ ID NO: 1810 - DNA, 20 bp, synthetic construct
  misc_feature 1..20: note = Synthetic oligonucleotide
  source 1..20: mol_type = other DNA
atgctcttttttaaataaaa

SEQ ID NO: 1811 - DNA, 20 bp, synthetic construct
  misc_feature 1..20: note = Synthetic oligonucleotide
  source 1..20: mol_type = other DNA
tgtcttgacttctcttgcaa

SEQ ID NO: 1812 - DNA, 20 bp, synthetic construct
  misc_feature 1..20: note = Synthetic oligonucleotide
  source 1..20: mol_type = other DNA
attgagtttttaataaggct

SEQ ID NO: 1813 - DNA, 20 bp, synthetic construct
  misc_feature 1..20: note = Synthetic oligonucleotide
  source 1..20: mol_type = other DNA
atattaacactatctagact

SEQ ID NO: 1814 - DNA, 20 bp, synthetic construct
  misc_feature 1..20: note = Synthetic oligonucleotide
  source 1..20: mol_type = other DNA
ttttaattttttctccccta

SEQ ID NO: 1815 - DNA, 20 bp, synthetic construct
  misc_feature 1..20: note = Synthetic oligonucleotide
  source 1..20: mol_type = other DNA
agcagtttaaatctcaaata

SEQ ID NO: 1816 - DNA, 20 bp, synthetic construct
  misc_feature 1..20: note = Synthetic oligonucleotide
  source 1..20: mol_type = other DNA
aacagatacataacaggaca

SEQ ID NO: 1817 - DNA, 20 bp, synthetic construct
  misc_feature 1..20: note = Synthetic oligonucleotide
  source 1..20: mol_type = other DNA
caggattttttaataccacc

SEQ ID NO: 1818 - DNA, 20 bp, synthetic construct
  misc_feature 1..20: note = Synthetic oligonucleotide
  source 1..20: mol_type = other DNA
acaatatttcataaatctct

SEQ ID NO: 1819 - DNA, 20 bp, synthetic construct
  misc_feature 1..20: note = Synthetic oligonucleotide
  source 1..20: mol_type = other DNA
tgtagctcaataacttggtc

SEQ ID NO: 1820 - DNA, 20 bp, synthetic construct
  misc_feature 1..20: note = Synthetic oligonucleotide
  source 1..20: mol_type = other DNA
gcttgaaacataataataga

SEQ ID NO: 1821 - DNA, 20 bp, synthetic construct
  misc_feature 1..20: note = Synthetic oligonucleotide
  source 1..20: mol_type = other DNA
gtatcttagactattagcct

SEQ ID NO: 1822 - DNA, 20 bp, synthetic construct
  misc_feature 1..20: note = Synthetic oligonucleotide
  source 1..20: mol_type = other DNA
acactaatttatatttctta

SEQ ID NO: 1823 - DNA, 20 bp, synthetic construct
  misc_feature 1..20: note = Synthetic oligonucleotide
  source 1..20: mol_type = other DNA
tctttgttattctataggaa

SEQ ID NO: 1824 - DNA, 20 bp, synthetic construct
  misc_feature 1..20: note = Synthetic oligonucleotide
  source 1..20: mol_type = other DNA
taactagggtcaagttttta

SEQ ID NO: 1825 - DNA, 20 bp, synthetic construct
  misc_feature 1..20: note = Synthetic oligonucleotide
  source 1..20: mol_type = other DNA
tattattcctctaatgacaa

SEQ ID NO: 1826 - DNA, 20 bp, synthetic construct
  misc_feature 1..20: note = Synthetic oligonucleotide
  source 1..20: mol_type = other DNA
tttgaattctaaaactgaac

SEQ ID NO: 1827 - DNA, 20 bp, synthetic construct
  misc_feature 1..20: note = Synthetic oligonucleotide
  source 1..20: mol_type = other DNA
tttattgctataacaaacaa

SEQ ID NO: 1828 - DNA, 20 bp, synthetic construct
  misc_feature 1..20: note = Synthetic oligonucleotide
  source 1..20: mol_type = other DNA
tatgaagatcaaatttgtta

SEQ ID NO: 1829 - DNA, 20 bp, synthetic construct
  misc_feature 1..20: note = Synthetic oligonucleotide
  source 1..20: mol_type = other DNA
tttatgcactaccatgcctt

SEQ ID NO: 1830 - DNA, 20 bp, synthetic construct
  misc_feature 1..20: note = Synthetic oligonucleotide
  source 1..20: mol_type = other DNA
ttagagaactaaacaactta

SEQ ID NO: 1831 - DNA, 20 bp, synthetic construct
  misc_feature 1..20: note = Synthetic oligonucleotide
  source 1..20: mol_type = other DNA
atcaaccaaatagggccaaa

SEQ ID NO: 1832 - DNA, 20 bp, synthetic construct
  misc_feature 1..20: note = Synthetic oligonucleotide
  source 1..20: mol_type = other DNA
ggcaaagctcacaaatgttt

SEQ ID NO: 1833 - DNA, 20 bp, synthetic construct
  misc_feature 1..20: note = Synthetic oligonucleotide
  source 1..20: mol_type = other DNA
ttgcatgatcccaataataa

SEQ ID NO: 1834 - DNA, 20 bp, synthetic construct
  misc_feature 1..20: note = Synthetic oligonucleotide
  source 1..20: mol_type = other DNA
aaagcaattataattatcca

SEQ ID NO: 1835 - DNA, 20 bp, synthetic construct
  misc_feature 1..20: note = Synthetic oligonucleotide
  source 1..20: mol_type = other DNA
attcttcataggcaacttga

SEQ ID NO: 1836 - DNA, 20 bp, synthetic construct
  misc_feature 1..20: note = Synthetic oligonucleotide
  source 1..20: mol_type = other DNA
cattcattacataaatgcat

SEQ ID NO: 1837 - DNA, 20 bp, synthetic construct
  misc_feature 1..20: note = Synthetic oligonucleotide
  source 1..20: mol_type = other DNA
tggaggctaaatataaaaaa

SEQ ID NO: 1838 - DNA, 20 bp, synthetic construct
  misc_feature 1..20: note = Synthetic oligonucleotide
  source 1..20: mol_type = other DNA
tcaaagtcacaaattaacac

SEQ ID NO: 1839 - DNA, 20 bp, synthetic construct
  misc_feature 1..20: note = Synthetic oligonucleotide
  source 1..20: mol_type = other DNA
cattcaattattcattccaa

SEQ ID NO: 1840 - DNA, 20 bp, synthetic construct
  misc_feature 1..20: note = Synthetic oligonucleotide
  source 1..20: mol_type = other DNA
gtaaattaatttattgctta

SEQ ID NO: 1841 - DNA, 20 bp, synthetic construct
  misc_feature 1..20: note = Synthetic oligonucleotide
  source 1..20: mol_type = other DNA
aaacatacatataattcata

SEQ ID NO: 1842 - DNA, 20 bp, synthetic construct
  misc_feature 1..20: note = Synthetic oligonucleotide
  source 1..20: mol_type = other DNA
atttctaaatttaatattgc

SEQ ID NO: 1843 - DNA, 20 bp, synthetic construct
  misc_feature 1..20: note = Synthetic oligonucleotide
  source 1..20: mol_type = other DNA
ctcttcattcctacttctaa

SEQ ID NO: 1844 - DNA, 20 bp, synthetic construct
  misc_feature 1..20: note = Synthetic oligonucleotide
  source 1..20: mol_type = other DNA
tcttaatttttatatatgtt

SEQ ID NO: 1845 - DNA, 20 bp, synthetic construct
  misc_feature 1..20: note = Synthetic oligonucleotide
  source 1..20: mol_type = other DNA
atttttccttttaattctct

SEQ ID NO: 1846 - DNA, 20 bp, synthetic construct
  misc_feature 1..20: note = Synthetic oligonucleotide
  source 1..20: mol_type = other DNA
ggacatttaaataatagata

SEQ ID NO: 1847 - DNA, 20 bp, synthetic construct
  misc_feature 1..20: note = Synthetic oligonucleotide
  source 1..20: mol_type = other DNA
agtgtattcaaataatatta

SEQ ID NO: 1848 - DNA, 20 bp, synthetic construct
  misc_feature 1..20: note = Synthetic oligonucleotide
  source 1..20: mol_type = other DNA
acatacatatacacttgcca

SEQ ID NO: 1849 - DNA, 20 bp, synthetic construct
  misc_feature 1..20: note = Synthetic oligonucleotide
  source 1..20: mol_type = other DNA
attacatattttaattgttt

SEQ ID NO: 1850 - DNA, 20 bp, synthetic construct
  misc_feature 1..20: note = Synthetic oligonucleotide
  source 1..20: mol_type = other DNA
ccttatttaaacatttttac

SEQ ID NO: 1851 - DNA, 20 bp, synthetic construct
  misc_feature 1..20: note = Synthetic oligonucleotide
  source 1..20: mol_type = other DNA
gcatggcttccacattatta

SEQ ID NO: 1852 - DNA, 20 bp, synthetic construct
  misc_feature 1..20: note = Synthetic oligonucleotide
  source 1..20: mol_type = other DNA
tttagatattatacttccaa

SEQ ID NO: 1853 - DNA, 20 bp, synthetic construct
  misc_feature 1..20: note = Synthetic oligonucleotide
  source 1..20: mol_type = other DNA
cctgtattttctcttattta

SEQ ID NO: 1854 - DNA, 20 bp, synthetic construct
  misc_feature 1..20: note = Synthetic oligonucleotide
  source 1..20: mol_type = other DNA
ataaaatatttccttagcat

SEQ ID NO: 1855 - DNA, 20 bp, synthetic construct
  misc_feature 1..20: note = Synthetic oligonucleotide
  source 1..20: mol_type = other DNA
tagcactactataatggatt

SEQ ID NO: 1856 - DNA, 20 bp, synthetic construct
  misc_feature 1..20: note = Synthetic oligonucleotide
  source 1..20: mol_type = other DNA
ttctattaaattttatgatc

SEQ ID NO: 1857 - DNA, 20 bp, synthetic construct
  misc_feature 1..20: note = Synthetic oligonucleotide
  source 1..20: mol_type = other DNA
cagtctgctctcaataataa

SEQ ID NO: 1858 - DNA, 20 bp, synthetic construct
  misc_feature 1..20: note = Synthetic oligonucleotide
  source 1..20: mol_type = other DNA
agactcattttaattacaca

SEQ ID NO: 1859 - DNA, 20 bp, synthetic construct
  misc_feature 1..20: note = Synthetic oligonucleotide
  source 1..20: mol_type = other DNA
attatcctaaacatgtgcat

SEQ ID NO: 1860 - DNA, 20 bp, synthetic construct
  misc_feature 1..20: note = Synthetic oligonucleotide
  source 1..20: mol_type = other DNA
tggtttctttgaacccagtt

SEQ ID NO: 1861 - DNA, 20 bp, synthetic construct
  misc_feature 1..20: note = Synthetic oligonucleotide
  source 1..20: mol_type = other DNA
atcctccctcttttcctgtg

SEQ ID NO: 1862 - DNA, 20 bp, synthetic construct
  misc_feature 1..20: note = Synthetic oligonucleotide
  source 1..20: mol_type = other DNA
acatcaaacactacttgttc

SEQ ID NO: 1863 - DNA, 20 bp, synthetic construct
  misc_feature 1..20: note = Synthetic oligonucleotide
  source 1..20: mol_type = other DNA
aatcttcttatatttacttc

SEQ ID NO: 1864 - DNA, 20 bp, synthetic construct
  misc_feature 1..20: note = Synthetic oligonucleotide
  source 1..20: mol_type = other DNA
atgtgttgaatataacagtc

SEQ ID NO: 1865 - DNA, 20 bp, synthetic construct
  misc_feature 1..20: note = Synthetic oligonucleotide
  source 1..20: mol_type = other DNA
gaatcgagagattgctttcc

SEQ ID NO: 1866 - DNA, 20 bp, synthetic construct
  misc_feature 1..20: note = Synthetic oligonucleotide
  source 1..20: mol_type = other DNA
ttgaaagtagtaccattccc

SEQ ID NO: 1867 - DNA, 20 bp, synthetic construct
  misc_feature 1..20: note = Synthetic oligonucleotide
  source 1..20: mol_type = other DNA
gcctacttccttccaaggaa

SEQ ID NO: 1868 - DNA, 20 bp, synthetic construct
  misc_feature 1..20: note = Synthetic oligonucleotide
  source 1..20: mol_type = other DNA
aaccatggtttacaacagtc

SEQ ID NO: 1869 - DNA, 20 bp, synthetic construct
  misc_feature 1..20: note = Synthetic oligonucleotide
  source 1..20: mol_type = other DNA
aaaatcgattcctttctgca

SEQ ID NO: 1870 - DNA, 20 bp, synthetic construct
  misc_feature 1..20: note = Synthetic oligonucleotide
  source 1..20: mol_type = other DNA
atgttttcctcaaattccac

SEQ ID NO: 1871 - DNA, 20 bp, synthetic construct
  misc_feature 1..20: note = Synthetic oligonucleotide
  source 1..20: mol_type = other DNA
ttacatcaaacatctctcca

SEQ ID NO: 1872 - DNA, 20 bp, synthetic construct
  misc_feature 1..20: note = Synthetic oligonucleotide
  source 1..20: mol_type = other DNA
acctttttaactttttgctt

SEQ ID NO: 1873 - DNA, 20 bp, synthetic construct
  misc_feature 1..20: note = Synthetic oligonucleotide
  source 1..20: mol_type = other DNA
tcgatactatttctccagtt

SEQ ID NO: 1874 - DNA, 20 bp, synthetic construct
  misc_feature 1..20: note = Synthetic oligonucleotide
  source 1..20: mol_type = other DNA
aggacacttatcaaaaatgt

SEQ ID NO: 1875 - DNA, 20 bp, synthetic construct
  misc_feature 1..20: note = Synthetic oligonucleotide
  source 1..20: mol_type = other DNA
aagcagacttttatttttta

SEQ ID NO: 1876 - DNA, 20 bp, synthetic construct
  misc_feature 1..20: note = Synthetic oligonucleotide
  source 1..20: mol_type = other DNA
aattacatcatattacctgt

SEQ ID NO: 1877 - DNA, 20 bp, synthetic construct
  misc_feature 1..20: note = Synthetic oligonucleotide
  source 1..20: mol_type = other DNA
caatttgcttcactttacca

SEQ ID NO: 1878 - DNA, 20 bp, synthetic construct
  misc_feature 1..20: note = Synthetic oligonucleotide
  source 1..20: mol_type = other DNA
gcttcaatttaaaagtgcta

SEQ ID NO: 1879 - DNA, 20 bp, synthetic construct
  misc_feature 1..20: note = Synthetic oligonucleotide
  source 1..20: mol_type = other DNA
gctgggatcccatattatat

SEQ ID NO: 1880 - DNA, 20 bp, synthetic construct
  misc_feature 1..20: note = Synthetic oligonucleotide
  source 1..20: mol_type = other DNA
gcatgcatttcaccaacaca

SEQ ID NO: 1881 - DNA, 20 bp, synthetic construct
  misc_feature 1..20: note = Synthetic oligonucleotide
  source 1..20: mol_type = other DNA
atttgtttttcagatagatt

SEQ ID NO: 1882 - DNA, 20 bp, synthetic construct
  misc_feature 1..20: note = Synthetic oligonucleotide
  source 1..20: mol_type = other DNA
agtagttatccaatacactc

SEQ ID NO: 1883 - DNA, 20 bp, synthetic construct
  misc_feature 1..20: note = Synthetic oligonucleotide
  source 1..20: mol_type = other DNA
attttataaaatcattcccc

SEQ ID NO: 1884 - DNA, 20 bp, synthetic construct
  misc_feature 1..20: note = Synthetic oligonucleotide
  source 1..20: mol_type = other DNA
gtcttcttccacataaaggt

SEQ ID NO: 1885 - DNA, 20 bp, synthetic construct
  misc_feature 1..20: note = Synthetic oligonucleotide
  source 1..20: mol_type = other DNA
gtctactcaaacaaacacta

SEQ ID NO: 1886 - DNA, 20 bp, synthetic construct
  misc_feature 1..20: note = Synthetic oligonucleotide
  source 1..20: mol_type = other DNA
aagaatttcataaacttcat

SEQ ID NO: 1887 - DNA, 20 bp, synthetic construct
  misc_feature 1..20: note = Synthetic oligonucleotide
  source 1..20: mol_type = other DNA
atggagttaaaccatagagc

SEQ ID NO: 1888 - DNA, 20 bp, synthetic construct
  misc_feature 1..20: note = Synthetic oligonucleotide
  source 1..20: mol_type = other DNA
gtttattcctcaatattttt

SEQ ID NO: 1889 - DNA, 20 bp, synthetic construct
  misc_feature 1..20: note = Synthetic oligonucleotide
  source 1..20: mol_type = other DNA
gcacagtattttacttatca

SEQ ID NO: 1890 - DNA, 20 bp, synthetic construct
  misc_feature 1..20: note = Synthetic oligonucleotide
  source 1..20: mol_type = other DNA
ataatttctatcaatattaa

SEQ ID NO: 1891 - DNA, 20 bp, synthetic construct
  misc_feature 1..20: note = Synthetic oligonucleotide
  source 1..20: mol_type = other DNA
cagtcattcctaatacatta

SEQ ID NO: 1892 - DNA, 20 bp, synthetic construct
  misc_feature 1..20: note = Synthetic oligonucleotide
  source 1..20: mol_type = other DNA
gtcttccctatctcaaccaa

SEQ ID NO: 1893 - DNA, 20 bp, synthetic construct
  misc_feature 1..20: note = Synthetic oligonucleotide
  source 1..20: mol_type = other DNA
tgcatcttcattaccatcaa

SEQ ID NO: 1894 - DNA, 20 bp, synthetic construct
  misc_feature 1..20: note = Synthetic oligonucleotide
  source 1..20: mol_type = other DNA
cttctctttttaacctgaat

SEQ ID NO: 1895 - DNA, 20 bp, synthetic construct
  misc_feature 1..20: note = Synthetic oligonucleotide
  source 1..20: mol_type = other DNA
gtcacattctcatcatattt

SEQ ID NO: 1896 - DNA, 20 bp, synthetic construct
  misc_feature 1..20: note = Synthetic oligonucleotide
  source 1..20: mol_type = other DNA
tgtgtagctcaataacttgg

SEQ ID NO: 1897 - DNA, 20 bp, synthetic construct
  misc_feature 1..20: note = Synthetic oligonucleotide
  source 1..20: mol_type = other DNA
gaacatacaattattttaaa

SEQ ID NO: 1898 - DNA, 20 bp, synthetic construct
  misc_feature 1..20: note = Synthetic oligonucleotide
  source 1..20: mol_type = other DNA
acctctaactttactgggct

SEQ ID NO: 1899 - DNA, 20 bp, synthetic construct
  misc_feature 1..20: note = Synthetic oligonucleotide
  source 1..20: mol_type = other DNA
tgtcactcctccctttgaca

SEQ ID NO: 1900 - DNA, 20 bp, synthetic construct
  misc_feature 1..20: note = Synthetic oligonucleotide
  source 1..20: mol_type = other DNA
agagtataaaattataggac

SEQ ID NO: 1901 - DNA, 20 bp, synthetic construct
  misc_feature 1..20: note = Synthetic oligonucleotide
  source 1..20: mol_type = other DNA
atcattttaataaaagtata

SEQ ID NO: 1902 - DNA, 20 bp, synthetic construct
  misc_feature 1..20: note = Synthetic oligonucleotide
  source 1..20: mol_type = other DNA
atattattcctctaatgaca

SEQ ID NO: 1903 - DNA, 20 bp, synthetic construct
  misc_feature 1..20: note = Synthetic oligonucleotide
  source 1..20: mol_type = other DNA
attttgaattctaaaactga

SEQ ID NO: 1904 - DNA, 20 bp, synthetic construct
  misc_feature 1..20: note = Synthetic oligonucleotide
  source 1..20: mol_type = other DNA
acaatttttctttattgcta

SEQ ID NO: 1905 - DNA, 20 bp, synthetic construct
  misc_feature 1..20: note = Synthetic oligonucleotide
  source 1..20: mol_type = other DNA
gcaaaattacttattaagtt

SEQ ID NO: 1906 - DNA, 20 bp, synthetic construct
  misc_feature 1..20: note = Synthetic oligonucleotide
  source 1..20: mol_type = other DNA
atacttactccacattcttt

SEQ ID NO: 1907 - DNA, 20 bp, synthetic construct
  misc_feature 1..20: note = Synthetic oligonucleotide
  source 1..20: mol_type = other DNA
atttagagaactaaacaact

SEQ ID NO: 1908 - DNA, 20 bp, synthetic construct
  misc_feature 1..20: note = Synthetic oligonucleotide
  source 1..20: mol_type = other DNA
catcaaccaaatagggccaa

SEQ ID NO: 1909 - DNA, 20 bp, synthetic construct
  misc_feature 1..20: note = Synthetic oligonucleotide
  source 1..20: mol_type = other DNA
taggaagcatcacttaccct

SEQ ID NO: 1910 - DNA, 20 bp, synthetic construct
  misc_feature 1..20: note = Synthetic oligonucleotide
  source 1..20: mol_type = other DNA
ccatgtttcttaatagcaaa

SEQ ID NO: 1911 - DNA, 20 bp, synthetic construct
  misc_feature 1..20: note = Synthetic oligonucleotide
  source 1..20: mol_type = other DNA
ttgttaatcattaatttcct

SEQ ID NO: 1912 - DNA, 20 bp, synthetic construct
  misc_feature 1..20: note = Synthetic oligonucleotide
  source 1..20: mol_type = other DNA
cattcttcataggcaacttg

SEQ ID NO: 1913 - DNA, 20 bp, synthetic construct
  misc_feature 1..20: note = Synthetic oligonucleotide
  source 1..20: mol_type = other DNA
agtttatattttaactgcca

SEQ ID NO: 1914 - DNA, 20 bp, synthetic construct
  misc_feature 1..20: note = Synthetic oligonucleotide
  source 1..20: mol_type = other DNA
ggtgttcaaaatatacctta

SEQ ID NO: 1915 - DNA, 20 bp, synthetic construct
  misc_feature 1..20: note = Synthetic oligonucleotide
  source 1..20: mol_type = other DNA
attcaaagtcacaaattaac

SEQ ID NO: 1916 - DNA, 20 bp, synthetic construct
  misc_feature 1..20: note = Synthetic oligonucleotide
  source 1..20: mol_type = other DNA
ctaaaataaaatcattcaat

SEQ ID NO: 1917 - DNA, 20 bp, synthetic construct
  misc_feature 1..20: note = Synthetic oligonucleotide
  source 1..20: mol_type = other DNA
cctaagtaaattaatttatt

SEQ ID NO: 1918 - DNA, 20 bp, synthetic construct
  misc_feature 1..20: note = Synthetic oligonucleotide
  source 1..20: mol_type = other DNA
aactcatttattactggaaa

SEQ ID NO: 1919 - DNA, 20 bp, synthetic construct
  misc_feature 1..20: note = Synthetic oligonucleotide
  source 1..20: mol_type = other DNA
tttaacaaaattaaataaat

SEQ ID NO: 1920 - DNA, 20 bp, synthetic construct
  misc_feature 1..20: note = Synthetic oligonucleotide
  source 1..20: mol_type = other DNA
cctctcttcattcctacttc

SEQ ID NO: 1921 - DNA, 20 bp, synthetic construct
  misc_feature 1..20: note = Synthetic oligonucleotide
  source 1..20: mol_type = other DNA
atgacctatcttaattttta

SEQ ID NO: 1922 - DNA, 20 bp, synthetic construct
  misc_feature 1..20: note = Synthetic oligonucleotide
  source 1..20: mol_type = other DNA
atattatcccatattatagt

SEQ ID NO: 1923 - DNA, 20 bp, synthetic construct
  misc_feature 1..20: note = Synthetic oligonucleotide
  source 1..20: mol_type = other DNA
catgtgtatattactagact

SEQ ID NO: 1924 - DNA, 20 bp, synthetic construct
  misc_feature 1..20: note = Synthetic oligonucleotide
  source 1..20: mol_type = other DNA
agtgaactttattaaagcta

SEQ ID NO: 1925 - DNA, 20 bp, synthetic construct
  misc_feature 1..20: note = Synthetic oligonucleotide
  source 1..20: mol_type = other DNA
gatcaaccttcctattgtaa

SEQ ID NO: 1926 - DNA, 20 bp, synthetic construct
  misc_feature 1..20: note = Synthetic oligonucleotide
  source 1..20: mol_type = other DNA
catctataaaataaatgtaa

SEQ ID NO: 1927 - DNA, 20 bp, synthetic construct
  misc_feature 1..20: note = Synthetic oligonucleotide
  source 1..20: mol_type = other DNA
cagatattttctattttctt

SEQ ID NO: 1928 - DNA, 20 bp, synthetic construct
  misc_feature 1..20: note = Synthetic oligonucleotide
  source 1..20: mol_type = other DNA
tgtttttattttactgccaa

SEQ ID NO: 1929 - DNA, 20 bp, synthetic construct
  misc_feature 1..20: note = Synthetic oligonucleotide
  source 1..20: mol_type = other DNA
atctaataaacatcaaggta

SEQ ID NO: 1930 - DNA, 20 bp, synthetic construct
  misc_feature 1..20: note = Synthetic oligonucleotide
  source 1..20: mol_type = other DNA
atttcaaattataaaagaca

SEQ ID NO: 1931 - DNA, 20 bp, synthetic construct
  misc_feature 1..20: note = Synthetic oligonucleotide
  source 1..20: mol_type = other DNA
atgtggattttctctagaaa

SEQ ID NO: 1932 - DNA, 20 bp, synthetic construct
  misc_feature 1..20: note = Synthetic oligonucleotide
  source 1..20: mol_type = other DNA
gtttatagcactactataat

SEQ ID NO: 1933 - DNA, 20 bp, synthetic construct
  misc_feature 1..20: note = Synthetic oligonucleotide
  source 1..20: mol_type = other DNA
attctattaaattttatgat

SEQ ID NO: 1934 - DNA, 20 bp, synthetic construct
  misc_feature 1..20: note = Synthetic oligonucleotide
  source 1..20: mol_type = other DNA
aaattctccataaatttgac

SEQ ID NO: 1935 - DNA, 20 bp, synthetic construct
  misc_feature 1..20: note = Synthetic oligonucleotide
  source 1..20: mol_type = other DNA
ctgttttccataaaagctat

SEQ ID NO: 1936 - DNA, 20 bp, synthetic construct
  misc_feature 1..20: note = Synthetic oligonucleotide
  source 1..20: mol_type = other DNA
ttcattttcatcactatata

SEQ ID NO: 1937 - DNA, 20 bp, synthetic construct
  misc_feature 1..20: note = Synthetic oligonucleotide
  source 1..20: mol_type = other DNA
gtggtttctttgaacccagt

SEQ ID NO: 1938 - DNA, 20 bp, synthetic construct
  misc_feature 1..20: note = Synthetic oligonucleotide
  source 1..20: mol_type = other DNA
ctgtgtttcataacaggcaa

SEQ ID NO: 1939 - DNA, 20 bp, synthetic construct
  misc_feature 1..20: note = Synthetic oligonucleotide
  source 1..20: mol_type = other DNA
tttttggacatcaaacacta

SEQ ID NO: 1940 - DNA, 20 bp, synthetic construct
  misc_feature 1..20: note = Synthetic oligonucleotide
  source 1..20: mol_type = other DNA
cttaaatcttcttatattta

SEQ ID NO: 1941 - DNA, 20 bp, synthetic construct
  misc_feature 1..20: note = Synthetic oligonucleotide
  source 1..20: mol_type = other DNA
atgtaaatcataacacagaa

SEQ ID NO: 1942 - DNA, 20 bp, synthetic construct
  misc_feature 1..20: note = Synthetic oligonucleotide
  source 1..20: mol_type = other DNA
tgaatcgagagattgctttc

SEQ ID NO: 1943 - DNA, 20 bp, synthetic construct
  misc_feature 1..20: note = Synthetic oligonucleotide
  source 1..20: mol_type = other DNA
tgctcactgtcctattgaaa

SEQ ID NO: 1944 - DNA, 20 bp, synthetic construct
  misc_feature 1..20: note = Synthetic oligonucleotide
  source 1..20: mol_type = other DNA
gagaagaaaatctcttttca

SEQ ID NO: 1945 - DNA, 20 bp, synthetic construct
  misc_feature 1..20: note = Synthetic oligonucleotide
  source 1..20: mol_type = other DNA
tcacctttaaccatggttta

SEQ ID NO: 1946 - DNA, 20 bp, synthetic construct
  misc_feature 1..20: note = Synthetic oligonucleotide
  source 1..20: mol_type = other DNA
gtatttttcttttaacaaaa

SEQ ID NO: 1947 - DNA, 20 bp, synthetic construct
  misc_feature 1..20: note = Synthetic oligonucleotide
  source 1..20: mol_type = other DNA
agcatgttttcctcaaattc

SEQ ID NO: 1948 - DNA, 20 bp, synthetic construct
  misc_feature 1..20: note = Synthetic oligonucleotide
  source 1..20: mol_type = other DNA
cttacatcaaacatctctcc

SEQ ID NO: 1949 - DNA, 20 bp, synthetic construct
  misc_feature 1..20: note = Synthetic oligonucleotide
  source 1..20: mol_type = other DNA
tgatacctttttaacttttt

SEQ ID NO: 1950 - DNA, 20 bp, synthetic construct
  misc_feature 1..20: note = Synthetic oligonucleotide
  source 1..20: mol_type = other DNA
ttacataaaaatttaacttc

SEQ ID NO: 1951 - DNA, 20 bp, synthetic construct
  misc_feature 1..20: note = Synthetic oligonucleotide
  source 1..20: mol_type = other DNA
aaaggacacttatcaaaaat

SEQ ID NO: 1952 - DNA, 20 bp, synthetic construct
  misc_feature 1..20: note = Synthetic oligonucleotide
  source 1..20: mol_type = other DNA
ttactatttacaaagcagac

SEQ ID NO: 1953 - DNA, 20 bp, synthetic construct
  misc_feature 1..20: note = Synthetic oligonucleotide
  source 1..20: mol_type = other DNA
caattacatcatattacctg

SEQ ID NO: 1954 - DNA, 20 bp, synthetic construct
  misc_feature 1..20: note = Synthetic oligonucleotide
  source 1..20: mol_type = other DNA
acaatttgcttcactttacc

SEQ ID NO: 1955 - DNA, 20 bp, synthetic construct
  misc_feature 1..20: note = Synthetic oligonucleotide
  source 1..20: mol_type = other DNA
tgcttcaatttaaaagtgct

SEQ ID NO: 1956 - DNA, 20 bp, synthetic construct
  misc_feature 1..20: note = Synthetic oligonucleotide
  source 1..20: mol_type = other DNA
agctgggatcccatattata

SEQ ID NO: 1957 - DNA, 20 bp, synthetic construct
  misc_feature 1..20: note = Synthetic oligonucleotide
  source 1..20: mol_type = other DNA
tgcatgcatttcaccaacac

SEQ ID NO: 1958 - DNA, 20 bp, synthetic construct
  misc_feature 1..20: note = Synthetic oligonucleotide
  source 1..20: mol_type = other DNA
tgtgttctttacatttgttt

SEQ ID NO: 1959 - DNA, 20 bp, synthetic construct
  misc_feature 1..20: note = Synthetic oligonucleotide
  source 1..20: mol_type = other DNA
aagtagttatccaatacact

SEQ ID NO: 1960 - DNA, 20 bp, synthetic construct
  misc_feature 1..20: note = Synthetic oligonucleotide
  source 1..20: mol_type = other DNA
atgtagaactacaaactcta

SEQ ID NO: 1961 - DNA, 20 bp, synthetic construct
  misc_feature 1..20: note = Synthetic oligonucleotide
  source 1..20: mol_type = other DNA
ataagattttttcattatta

SEQ ID NO: 1962 - DNA, 20 bp, synthetic construct
  misc_feature 1..20: note = Synthetic oligonucleotide
  source 1..20: mol_type = other DNA
actatatccatatcatttta

SEQ ID NO: 1963 - DNA, 20 bp, synthetic construct
  misc_feature 1..20: note = Synthetic oligonucleotide
  source 1..20: mol_type = other DNA
ctttatctctccaaaccatc

SEQ ID NO: 1964 - DNA, 20 bp, synthetic construct
  misc_feature 1..20: note = Synthetic oligonucleotide
  source 1..20: mol_type = other DNA
atatggagttaaaccataga

SEQ ID NO: 1965 - DNA, 20 bp, synthetic construct
  misc_feature 1..20: note = Synthetic oligonucleotide
  source 1..20: mol_type = other DNA
acagatatttcacctcatta

SEQ ID NO: 1966 - DNA, 20 bp, synthetic construct
  misc_feature 1..20: note = Synthetic oligonucleotide
  source 1..20: mol_type = other DNA
tctttgctcataataccatt

SEQ ID NO: 1967 - DNA, 20 bp, synthetic construct
  misc_feature 1..20: note = Synthetic oligonucleotide
  source 1..20: mol_type = other DNA
tataatttctatcaatatta

SEQ ID NO: 1968 - DNA, 20 bp, synthetic construct
  misc_feature 1..20: note = Synthetic oligonucleotide
  source 1..20: mol_type = other DNA
ctagcatattccattacttc

SEQ ID NO: 1969 - DNA, 20 bp, synthetic construct
  misc_feature 1..20: note = Synthetic oligonucleotide
  source 1..20: mol_type = other DNA
tgtcttccctatctcaacca

SEQ ID NO: 1970 - DNA, 20 bp, synthetic construct
  misc_feature 1..20: note = Synthetic oligonucleotide
  source 1..20: mol_type = other DNA
cactgcatcttcattaccat

SEQ ID NO: 1971 - DNA, 20 bp, synthetic construct
  misc_feature 1..20: note = Synthetic oligonucleotide
  source 1..20: mol_type = other DNA
ccttctctttttaacctgaa

SEQ ID NO: 1972 - DNA, 20 bp, synthetic construct
  misc_feature 1..20: note = Synthetic oligonucleotide
  source 1..20: mol_type = other DNA
ccgtagcttccctacagcta

SEQ ID NO: 1973 - DNA, 20 bp, synthetic construct
  misc_feature 1..20: note = Synthetic oligonucleotide
  source 1..20: mol_type = other DNA
atgtgtagctcaataacttg

SEQ ID NO: 1974 - DNA, 20 bp, synthetic construct
  misc_feature 1..20: note = Synthetic oligonucleotide
  source 1..20: mol_type = other DNA
aaggaacatacaattatttt

SEQ ID NO: 1975 - DNA, 20 bp, synthetic construct
  misc_feature 1..20: note = Synthetic oligonucleotide
  source 1..20: mol_type = other DNA
tctatatacctctaacttta

SEQ ID NO: 1976 - DNA, 20 bp, synthetic construct
  misc_feature 1..20: note = Synthetic oligonucleotide
  source 1..20: mol_type = other DNA
cttcagactttaccttcata

SEQ ID NO: 1977 - DNA, 20 bp, synthetic construct
  misc_feature 1..20: note = Synthetic oligonucleotide
  source 1..20: mol_type = other DNA
ttaccattaataactcattt

SEQ ID NO: 1978 - DNA, 20 bp, synthetic construct
  misc_feature 1..20: note = Synthetic oligonucleotide
  source 1..20: mol_type = other DNA
gctatcattttaataaaagt

SEQ ID NO: 1979 - DNA, 20 bp, synthetic construct
  misc_feature 1..20: note = Synthetic oligonucleotide
  source 1..20: mol_type = other DNA
agcagcccttatattattcc

SEQ ID NO: 1980 - DNA, 20 bp, synthetic construct
  misc_feature 1..20: note = Synthetic oligonucleotide
  source 1..20: mol_type = other DNA
tacatatcttatcaacactt

SEQ ID NO: 1981 - DNA, 20 bp, synthetic construct
  misc_feature 1..20: note = Synthetic oligonucleotide
  source 1..20: mol_type = other DNA
atgaaaacactcataagtaa

SEQ ID NO: 1982 - DNA, 20 bp, synthetic construct
  misc_feature 1..20: note = Synthetic oligonucleotide
  source 1..20: mol_type = other DNA
gctcataaaatcctgaacta

SEQ ID NO: 1983 - DNA, 20 bp, synthetic construct
  misc_feature 1..20: note = Synthetic oligonucleotide
  source 1..20: mol_type = other DNA
atatttatacttactccaca

SEQ ID NO: 1984 - DNA, 20 bp, synthetic construct
  misc_feature 1..20: note = Synthetic oligonucleotide
  source 1..20: mol_type = other DNA
tccattatatataatattta

SEQ ID NO: 1985 - DNA, 20 bp, synthetic construct
  misc_feature 1..20: note = Synthetic oligonucleotide
  source 1..20: mol_type = other DNA
tgcatcaaccaaatagggcc

SEQ ID NO: 1986 - DNA, 20 bp, synthetic construct
  misc_feature 1..20: note = Synthetic oligonucleotide
  source 1..20: mol_type = other DNA
atctacacttatcctggcta

SEQ ID NO: 1987 - DNA, 20 bp, synthetic construct
  misc_feature 1..20: note = Synthetic oligonucleotide
  source 1..20: mol_type = other DNA
tccatgtttcttaatagcaa

SEQ ID NO: 1988 - DNA, 20 bp, synthetic construct
  misc_feature 1..20: note = Synthetic oligonucleotide
  source 1..20: mol_type = other DNA
cctttgttaatcattaattt

SEQ ID NO: 1989 - DNA, 20 bp, synthetic construct
  misc_feature 1..20: note = Synthetic oligonucleotide
  source 1..20: mol_type = other DNA
gcattcttcataggcaactt

SEQ ID NO: 1990 - DNA, 20 bp, synthetic construct
  misc_feature 1..20: note = Synthetic oligonucleotide
  source 1..20: mol_type = other DNA
atactgctcctcattagcta

SEQ ID NO: 1991 - DNA, 20 bp, synthetic construct
  misc_feature 1..20: note = Synthetic oligonucleotide
  source 1..20: mol_type = other DNA
tggtgttcaaaatatacctt

SEQ ID NO: 1992 - DNA, 20 bp, synthetic construct
  misc_feature 1..20: note = Synthetic oligonucleotide
  source 1..20: mol_type = other DNA
gagactgaaattcaaagtca

SEQ ID NO: 1993 - DNA, 20 bp, synthetic construct
  misc_feature 1..20: note = Synthetic oligonucleotide
  source 1..20: mol_type = other DNA
tctaaaataaaatcattcaa

SEQ ID NO: 1994 - DNA, 20 bp, synthetic construct
  misc_feature 1..20: note = Synthetic oligonucleotide
  source 1..20: mol_type = other DNA
aattaattctataatactat

SEQ ID NO: 1995 - DNA, 20 bp, synthetic construct
  misc_feature 1..20: note = Synthetic oligonucleotide
  source 1..20: mol_type = other DNA
ttacaaatcaacatttcaca

SEQ ID NO: 1996 - DNA, 20 bp, synthetic construct
  misc_feature 1..20: note = Synthetic oligonucleotide
  source 1..20: mol_type = other DNA
atactatattataatatcaa

SEQ ID NO: 1997 - DNA, 20 bp, synthetic construct
  misc_feature 1..20: note = Synthetic oligonucleotide
  source 1..20: mol_type = other DNA
ctttttctttctaaaagatc

SEQ ID NO: 1998 - DNA, 20 bp, synthetic construct
  misc_feature 1..20: note = Synthetic oligonucleotide
  source 1..20: mol_type = other DNA
tcattgcttaataataggtc

SEQ ID NO: 1999 - DNA, 20 bp, synthetic construct
  misc_feature 1..20: note = Synthetic oligonucleotide
  source 1..20: mol_type = other DNA
tgatattatcccatattata

SEQ ID NO: 2000 - DNA, 20 bp, synthetic construct
  misc_feature 1..20: note = Synthetic oligonucleotide
  source 1..20: mol_type = other DNA
gtgacttttccaaatattac

SEQ ID NO: 2001 - DNA, 20 bp, synthetic construct
  misc_feature 1..20: note = Synthetic oligonucleotide
  source 1..20: mol_type = other DNA
ctgtttcctcctctctatta

SEQ ID NO: 2002 - DNA, 20 bp, synthetic construct
  misc_feature 1..20: note = Synthetic oligonucleotide
  source 1..20: mol_type = other DNA
tctcagttaaatatatttta

SEQ ID NO: 2003 - DNA, 20 bp, synthetic construct
  misc_feature 1..20: note = Synthetic oligonucleotide
  source 1..20: mol_type = other DNA
tttctgttacctactaagta

SEQ ID NO: 2004 - DNA, 20 bp, synthetic construct
  misc_feature 1..20: note = Synthetic oligonucleotide
  source 1..20: mol_type = other DNA
tgattcctcatcaatacctt

SEQ ID NO: 2005 - DNA, 20 bp, synthetic construct
  misc_feature 1..20: note = Synthetic oligonucleotide
  source 1..20: mol_type = other DNA
atgtttttattttactgcca

SEQ ID NO: 2006 - DNA, 20 bp, synthetic construct
  misc_feature 1..20: note = Synthetic oligonucleotide
  source 1..20: mol_type = other DNA
aatgatctaataaacatcaa

SEQ ID NO: 2007 - DNA, 20 bp, synthetic construct
  misc_feature 1..20: note = Synthetic oligonucleotide
  source 1..20: mol_type = other DNA
ggtgttttttttaattgctt

SEQ ID NO: 2008 - DNA, 20 bp, synthetic construct
  misc_feature 1..20: note = Synthetic oligonucleotide
  source 1..20: mol_type = other DNA
aatgcaataaactttagcca

SEQ ID NO: 2009 - DNA, 20 bp, synthetic construct
  misc_feature 1..20: note = Synthetic oligonucleotide
  source 1..20: mol_type = other DNA
ggctttttaatcatttgttt

SEQ ID NO: 2010 - DNA, 20 bp, synthetic construct
  misc_feature 1..20: note = Synthetic oligonucleotide
  source 1..20: mol_type = other DNA
aaaaattctattaaatttta

SEQ ID NO: 2011 - DNA, 20 bp, synthetic construct
  misc_feature 1..20: note = Synthetic oligonucleotide
  source 1..20: mol_type = other DNA
cacaaattctccataaattt

SEQ ID NO: 2012 - DNA, 20 bp, synthetic construct
  misc_feature 1..20: note = Synthetic oligonucleotide
  source 1..20: mol_type = other DNA
actgttttccataaaagcta

SEQ ID NO: 2013 - DNA, 20 bp, synthetic construct
  misc_feature 1..20: note = Synthetic oligonucleotide
  source 1..20: mol_type = other DNA
ctggaggtaatcattatcct

SEQ ID NO: 2014 - DNA, 20 bp, synthetic construct
  misc_feature 1..20: note = Synthetic oligonucleotide
  source 1..20: mol_type = other DNA
tgtggtttctttgaacccag

SEQ ID NO: 2015 - DNA, 20 bp, synthetic construct
  misc_feature 1..20: note = Synthetic oligonucleotide
  source 1..20: mol_type = other DNA
cacaaaatatcaactagctt

SEQ ID NO: 2016 - DNA, 20 bp, synthetic construct
  misc_feature 1..20: note = Synthetic oligonucleotide
  source 1..20: mol_type = other DNA
gaggcttctattacttccaa

SEQ ID NO: 2017 - DNA, 20 bp, synthetic construct
  misc_feature 1..20: note = Synthetic oligonucleotide
  source 1..20: mol_type = other DNA
atcttacctcttaatgctac

SEQ ID NO: 2018 - DNA, 20 bp, synthetic construct
  misc_feature 1..20: note = Synthetic oligonucleotide
  source 1..20: mol_type = other DNA
aaaaatgtaaatcataacac

SEQ ID NO: 2019 - DNA, 20 bp, synthetic construct
  misc_feature 1..20: note = Synthetic oligonucleotide
  source 1..20: mol_type = other DNA
actgaatcgagagattgctt

SEQ ID NO: 2020 - DNA, 20 bp, synthetic construct
  misc_feature 1..20: note = Synthetic oligonucleotide
  source 1..20: mol_type = other DNA
aatatattcatcccagttaa

SEQ ID NO: 2021 - DNA, 20 bp, synthetic construct
  misc_feature 1..20: note = Synthetic oligonucleotide
  source 1..20: mol_type = other DNA
tctctttcttatttctgttt

SEQ ID NO: 2022 - DNA, 20 bp, synthetic construct
  misc_feature 1..20: note = Synthetic oligonucleotide
  source 1..20: mol_type = other DNA
ttcacctttaaccatggttt

SEQ ID NO: 2023 - DNA, 20 bp, synthetic construct
  misc_feature 1..20: note = Synthetic oligonucleotide
  source 1..20: mol_type = other DNA
gctttctgcttcctaacaaa

SEQ ID NO: 2024 - DNA, 20 bp, synthetic construct
  misc_feature 1..20: note = Synthetic oligonucleotide
  source 1..20: mol_type = other DNA
tagcatgttttcctcaaatt

SEQ ID NO: 2025 - DNA, 20 bp, synthetic construct
  misc_feature 1..20: note = Synthetic oligonucleotide
  source 1..20: mol_type = other DNA
accacgcttacatcaaacat

SEQ ID NO: 2026 - DNA, 20 bp, synthetic construct
  misc_feature 1..20: note = Synthetic oligonucleotide
  source 1..20: mol_type = other DNA
ttgatacctttttaactttt

SEQ ID NO: 2027 - DNA, 20 bp, synthetic construct
  misc_feature 1..20: note = Synthetic oligonucleotide
  source 1..20: mol_type = other DNA
tttacataaaaatttaactt

SEQ ID NO: 2028 - DNA, 20 bp, synthetic construct
  misc_feature 1..20: note = Synthetic oligonucleotide
  source 1..20: mol_type = other DNA
gccaaaggacacttatcaaa

SEQ ID NO: 2029 - DNA, 20 bp, synthetic construct
  misc_feature 1..20: note = Synthetic oligonucleotide
  source 1..20: mol_type = other DNA
attactatttacaaagcaga

SEQ ID NO: 2030 - DNA, 20 bp, synthetic construct
  misc_feature 1..20: note = Synthetic oligonucleotide
  source 1..20: mol_type = other DNA
ccaattacatcatattacct

SEQ ID NO: 2031 - DNA, 20 bp, synthetic construct
  misc_feature 1..20: note = Synthetic oligonucleotide
  source 1..20: mol_type = other DNA
caagaagctcttccttgttt

SEQ ID NO: 2032 - DNA, 20 bp, synthetic construct
  misc_feature 1..20: note = Synthetic oligonucleotide
  source 1..20: mol_type = other DNA
gtgcttcaatttaaaagtgc

SEQ ID NO: 2033 - DNA, 20 bp, synthetic construct
  misc_feature 1..20: note = Synthetic oligonucleotide
  source 1..20: mol_type = other DNA
ataacttcactacctggttt

SEQ ID NO: 2034 - DNA, 20 bp, synthetic construct
  misc_feature 1..20: note = Synthetic oligonucleotide
  source 1..20: mol_type = other DNA
ctgcatgcatttcaccaaca

SEQ ID NO: 2035 - DNA, 20 bp, synthetic construct
  misc_feature 1..20: note = Synthetic oligonucleotide
  source 1..20: mol_type = other DNA
gtgtgttctttacatttgtt

SEQ ID NO: 2036 - DNA, 20 bp, synthetic construct
  misc_feature 1..20: note = Synthetic oligonucleotide
  source 1..20: mol_type = other DNA
ctgtaattctaaaaatctcc

SEQ ID NO: 2037 - DNA, 20 bp, synthetic construct
  misc_feature 1..20: note = Synthetic oligonucleotide
  source 1..20: mol_type = other DNA
tatcacattccaataaataa

SEQ ID NO: 2038 - DNA, 20 bp, synthetic construct
  misc_feature 1..20: note = Synthetic oligonucleotide
  source 1..20: mol_type = other DNA
ttaaaattttctatatacta

SEQ ID NO: 2039 - DNA, 20 bp, synthetic construct
  misc_feature 1..20: note = Synthetic oligonucleotide
  source 1..20: mol_type = other DNA
tttatggacattaaacttca

SEQ ID NO: 2040 - DNA, 20 bp, synthetic construct
  misc_feature 1..20: note = Synthetic oligonucleotide
  source 1..20: mol_type = other DNA
ggatatggagttaaaccata

SEQ ID NO: 2041 - DNA, 20 bp, synthetic construct
  misc_feature 1..20: note = Synthetic oligonucleotide
  source 1..20: mol_type = other DNA
tttaagaacattaattcttt

SEQ ID NO: 2042 - DNA, 20 bp, synthetic construct
  misc_feature 1..20: note = Synthetic oligonucleotide
  source 1..20: mol_type = other DNA
gtctttgctcataataccat

SEQ ID NO: 2043 - DNA, 20 bp, synthetic construct
  misc_feature 1..20: note = Synthetic oligonucleotide
  source 1..20: mol_type = other DNA
ttagttataatttctatcaa

SEQ ID NO: 2044 - DNA, 20 bp, synthetic construct
  misc_feature 1..20: note = Synthetic oligonucleotide
  source 1..20: mol_type = other DNA
gtagctatattcactagcat

SEQ ID NO: 2045 - DNA, 20 bp, synthetic construct
  misc_feature 1..20: note = Synthetic oligonucleotide
  source 1..20: mol_type = other DNA
tcagtttcttccatttgaaa

SEQ ID NO: 2046 - DNA, 20 bp, synthetic construct
  misc_feature 1..20: note = Synthetic oligonucleotide
  source 1..20: mol_type = other DNA
tcttcttttttcctaagtta

SEQ ID NO: 2047 - DNA, 20 bp, synthetic construct
  misc_feature 1..20: note = Synthetic oligonucleotide
  source 1..20: mol_type = other DNA
tatgtatccttctcttttta

SEQ ID NO: 2048 - DNA, 20 bp, synthetic construct
  misc_feature 1..20: note = Synthetic oligonucleotide
  source 1..20: mol_type = other DNA
tagaacagttctaattgtta

SEQ ID NO: 2049 - DNA, 20 bp, synthetic construct
  misc_feature 1..20: note = Synthetic oligonucleotide
  source 1..20: mol_type = other DNA
aatgtgtagctcaataactt

SEQ ID NO: 2050 - DNA, 20 bp, synthetic construct
  misc_feature 1..20: note = Synthetic oligonucleotide
  source 1..20: mol_type = other DNA
ttcccaatgtctactaggaa

SEQ ID NO: 2051 - DNA, 20 bp, synthetic construct
  misc_feature 1..20: note = Synthetic oligonucleotide
  source 1..20: mol_type = other DNA
cagcatctatatacctctaa

SEQ ID NO: 2052 - DNA, 20 bp, synthetic construct
  misc_feature 1..20: note = Synthetic oligonucleotide
  source 1..20: mol_type = other DNA
gtcatgactttaaataccag

SEQ ID NO: 2053 - DNA, 20 bp, synthetic construct
  misc_feature 1..20: note = Synthetic oligonucleotide
  source 1..20: mol_type = other DNA
tttcttaccattaataactc

SEQ ID NO: 2054 - DNA, 20 bp, synthetic construct
  misc_feature 1..20: note = Synthetic oligonucleotide
  source 1..20: mol_type = other DNA
catggctatcattttaataa

SEQ ID NO: 2055 - DNA, 20 bp, synthetic construct
  misc_feature 1..20: note = Synthetic oligonucleotide
  source 1..20: mol_type = other DNA
gattgacctattaccagtta

SEQ ID NO: 2056 - DNA, 20 bp, synthetic construct
  misc_feature 1..20: note = Synthetic oligonucleotide
  source 1..20: mol_type = other DNA
ttacatatcttatcaacact

SEQ ID NO: 2057 - DNA, 20 bp, synthetic construct
  misc_feature 1..20: note = Synthetic oligonucleotide
  source 1..20: mol_type = other DNA
gttttttcatccatatgaaa

SEQ ID NO: 2058 - DNA, 20 bp, synthetic construct
  misc_feature 1..20: note = Synthetic oligonucleotide
  source 1..20: mol_type = other DNA
taacatcattctaaaagtta

SEQ ID NO: 2059 - DNA, 20 bp, synthetic construct
  misc_feature 1..20: note = Synthetic oligonucleotide
  source 1..20: mol_type = other DNA
aaaatatttatacttactcc

SEQ ID NO: 2060 - DNA, 20 bp, synthetic construct
  misc_feature 1..20: note = Synthetic oligonucleotide
  source 1..20: mol_type = other DNA
ataatttccattatatataa

SEQ ID NO: 2061 - DNA, 20 bp, synthetic construct
  misc_feature 1..20: note = Synthetic oligonucleotide
  source 1..20: mol_type = other DNA
ttgcatcaaccaaatagggc

SEQ ID NO: 2062 - DNA, 20 bp, synthetic construct
  misc_feature 1..20: note = Synthetic oligonucleotide
  source 1..20: mol_type = other DNA
tgagaatctacacttatcct

SEQ ID NO: 2063 - DNA, 20 bp, synthetic construct
  misc_feature 1..20: note = Synthetic oligonucleotide
  source 1..20: mol_type = other DNA
tttttaaattttcctaggat

SEQ ID NO: 2064 - DNA, 20 bp, synthetic construct
  misc_feature 1..20: note = Synthetic oligonucleotide
  source 1..20: mol_type = other DNA
taactgaattcctcttcccc

SEQ ID NO: 2065 - DNA, 20 bp, synthetic construct
  misc_feature 1..20: note = Synthetic oligonucleotide
  source 1..20: mol_type = other DNA
aggcattcttcataggcaac

SEQ ID NO: 2066 - DNA, 20 bp, synthetic construct
  misc_feature 1..20: note = Synthetic oligonucleotide
  source 1..20: mol_type = other DNA
tcctttctctcctctaacaa

SEQ ID NO: 2067 - DNA, 20 bp, synthetic construct
  misc_feature 1..20: note = Synthetic oligonucleotide
  source 1..20: mol_type = other DNA
gtggtgttcaaaatatacct

SEQ ID NO: 2068 - DNA, 20 bp, synthetic construct
  misc_feature 1..20: note = Synthetic oligonucleotide
  source 1..20: mol_type = other DNA
cctaaacatcatcatccaca

SEQ ID NO: 2069 - DNA, 20 bp, synthetic construct
  misc_feature 1..20: note = Synthetic oligonucleotide
  source 1..20: mol_type = other DNA
aagttctaaaataaaatcat

SEQ ID NO: 2070 - DNA, 20 bp, synthetic construct
  misc_feature 1..20: note = Synthetic oligonucleotide
  source 1..20: mol_type = other DNA
ttgccactaattaattctat

SEQ ID NO: 2071 - DNA, 20 bp, synthetic construct
  misc_feature 1..20: note = Synthetic oligonucleotide
  source 1..20: mol_type = other DNA
ctacatttctcatttaacta

SEQ ID NO: 2072 - DNA, 20 bp, synthetic construct
  misc_feature 1..20: note = Synthetic oligonucleotide
  source 1..20: mol_type = other DNA
accactttaaaatctatcac

SEQ ID NO: 2073 - DNA, 20 bp, synthetic construct
  misc_feature 1..20: note = Synthetic oligonucleotide
  source 1..20: mol_type = other DNA
tttcaatttcacataggtta

SEQ ID NO: 2074 - DNA, 20 bp, synthetic construct
  misc_feature 1..20: note = Synthetic oligonucleotide
  source 1..20: mol_type = other DNA
ccttttttttcttattgcta

SEQ ID NO: 2075 - DNA, 20 bp, synthetic construct
  misc_feature 1..20: note = Synthetic oligonucleotide
  source 1..20: mol_type = other DNA
attatataaatatttagact

SEQ ID NO: 2076 - DNA, 20 bp, synthetic construct
  misc_feature 1..20: note = Synthetic oligonucleotide
  source 1..20: mol_type = other DNA
agtgacttttccaaatatta

SEQ ID NO: 2077 - DNA, 20 bp, synthetic construct
  misc_feature 1..20: note = Synthetic oligonucleotide
  source 1..20: mol_type = other DNA
attccataattctttagttc

SEQ ID NO: 2078 - DNA, 20 bp, synthetic construct
  misc_feature 1..20: note = Synthetic oligonucleotide
  source 1..20: mol_type = other DNA
tctttcttcctaccaagcta

SEQ ID NO: 2079 - DNA, 20 bp, synthetic construct
  misc_feature 1..20: note = Synthetic oligonucleotide
  source 1..20: mol_type = other DNA
cagcatgtttatcttagttc

SEQ ID NO: 2080 - DNA, 20 bp, synthetic construct
  misc_feature 1..20: note = Synthetic oligonucleotide
  source 1..20: mol_type = other DNA
tgtgattcctcatcaatacc

SEQ ID NO: 2081 - DNA, 20 bp, synthetic construct
  misc_feature 1..20: note = Synthetic oligonucleotide
  source 1..20: mol_type = other DNA
gcatgcacttttacttttca

SEQ ID NO: 2082 - DNA, 20 bp, synthetic construct
  misc_feature 1..20: note = Synthetic oligonucleotide
  source 1..20: mol_type = other DNA
taatgatctaataaacatca

SEQ ID NO: 2083 - DNA, 20 bp, synthetic construct
  misc_feature 1..20: note = Synthetic oligonucleotide
  source 1..20: mol_type = other DNA
ctgtctgttttcaatagcct

SEQ ID NO: 2084 - DNA, 20 bp, synthetic construct
  misc_feature 1..20: note = Synthetic oligonucleotide
  source 1..20: mol_type = other DNA
gttaaatcaaatatcaccaa

SEQ ID NO: 2085 - DNA, 20 bp, synthetic construct
  misc_feature 1..20: note = Synthetic oligonucleotide
  source 1..20: mol_type = other DNA
atttacattattacctgata

SEQ ID NO: 2086 - DNA, 20 bp, synthetic construct
  misc_feature 1..20: note = Synthetic oligonucleotide
  source 1..20: mol_type = other DNA
tcaaaaaattctattaaatt

SEQ ID NO: 2087 - DNA, 20 bp, synthetic construct
  misc_feature 1..20: note = Synthetic oligonucleotide
  source 1..20: mol_type = other DNA
gtgtaagacacaaattctcc

SEQ ID NO: 2088 - DNA, 20 bp, synthetic construct
  misc_feature 1..20: note = Synthetic oligonucleotide
  source 1..20: mol_type = other DNA
catatctactcacttagcta

SEQ ID NO: 2089 - DNA, 20 bp, synthetic construct
  misc_feature 1..20: note = Synthetic oligonucleotide
  source 1..20: mol_type = other DNA
cttctcaaacataaactcca

SEQ ID NO: 2090 - DNA, 20 bp, synthetic construct
  misc_feature 1..20: note = Synthetic oligonucleotide
  source 1..20: mol_type = other DNA
ttgtggtttctttgaaccca

SEQ ID NO: 2091 - DNA, 20 bp, synthetic construct
  misc_feature 1..20: note = Synthetic oligonucleotide
  source 1..20: mol_type = other DNA
acagtttcacaaaatatcaa

SEQ ID NO: 2092 - DNA, 20 bp, synthetic construct
  misc_feature 1..20: note = Synthetic oligonucleotide
  source 1..20: mol_type = other DNA
gaaatattcaatctttgccc

SEQ ID NO: 2093 - DNA, 20 bp, synthetic construct
  misc_feature 1..20: note = Synthetic oligonucleotide
  source 1..20: mol_type = other DNA
atctcaaatcttacctctta

SEQ ID NO: 2094 - DNA, 20 bp, synthetic construct
  misc_feature 1..20: note = Synthetic oligonucleotide
  source 1..20: mol_type = other DNA
ctgctcctttaatcactgtt

SEQ ID NO: 2095 - DNA, 20 bp, synthetic construct
  misc_feature 1..20: note = Synthetic oligonucleotide
  source 1..20: mol_type = other DNA
gctaattttctaatagggtt

SEQ ID NO: 2096 - DNA, 20 bp, synthetic construct
  misc_feature 1..20: note = Synthetic oligonucleotide
  source 1..20: mol_type = other DNA
tcaatatattcatcccagtt

SEQ ID NO: 2097 - DNA, 20 bp, synthetic construct
  misc_feature 1..20: note = Synthetic oligonucleotide
  source 1..20: mol_type = other DNA
gtctctttcttatttctgtt

SEQ ID NO: 2098 - DNA, 20 bp, synthetic construct
  misc_feature 1..20: note = Synthetic oligonucleotide
  source 1..20: mol_type = other DNA
gtttcacctttaaccatggt

SEQ ID NO: 2099 - DNA, 20 bp, synthetic construct
  misc_feature 1..20: note = Synthetic oligonucleotide
  source 1..20: mol_type = other DNA
ggttggaaatacagctgtct

SEQ ID NO: 2100 - DNA, 20 bp, synthetic construct
  misc_feature 1..20: note = Synthetic oligonucleotide
  source 1..20: mol_type = other DNA
aggtttcgaaccaattgtgc

SEQ ID NO: 2101 - DNA, 20 bp, synthetic construct
  misc_feature 1..20: note = Synthetic oligonucleotide
  source 1..20: mol_type = other DNA
acatttttccacctggcagt

SEQ ID NO: 2102 - DNA, 20 bp, synthetic construct
  misc_feature 1..20: note = Synthetic oligonucleotide
  source 1..20: mol_type = other DNA
acttgatacctttttaactt

SEQ ID NO: 2103 - DNA, 20 bp, synthetic construct
  misc_feature 1..20: note = Synthetic oligonucleotide
  source 1..20: mol_type = other DNA
atgttgaatttacataaaaa

SEQ ID NO: 2104 - DNA, 20 bp, synthetic construct
  misc_feature 1..20: note = Synthetic oligonucleotide
  source 1..20: mol_type = other DNA
tatttttattttatgccaaa

SEQ ID NO: 2105 - DNA, 20 bp, synthetic construct
  misc_feature 1..20: note = Synthetic oligonucleotide
  source 1..20: mol_type = other DNA
gtaaaattactatttacaaa

SEQ ID NO: 2106 - DNA, 20 bp, synthetic construct
  misc_feature 1..20: note = Synthetic oligonucleotide
  source 1..20: mol_type = other DNA
accaattacatcatattacc

SEQ ID NO: 2107 - DNA, 20 bp, synthetic construct
  misc_feature 1..20: note = Synthetic oligonucleotide
  source 1..20: mol_type = other DNA
ggcttttcatcattgagtgt

SEQ ID NO: 2108 - DNA, 20 bp, synthetic construct
  misc_feature 1..20: note = Synthetic oligonucleotide
  source 1..20: mol_type = other DNA
atcctagtccttgcttctta

SEQ ID NO: 2109 - DNA, 20 bp, synthetic construct
  misc_feature 1..20: note = Synthetic oligonucleotide
  source 1..20: mol_type = other DNA
tataacttcactacctggtt

SEQ ID NO: 2110 - DNA, 20 bp, synthetic construct
  misc_feature 1..20: note = Synthetic oligonucleotide
  source 1..20: mol_type = other DNA
acagcattttcctgcatgca

SEQ ID NO: 2111 - DNA, 20 bp, synthetic construct
  misc_feature 1..20: note = Synthetic oligonucleotide
  source 1..20: mol_type = other DNA
tgtgtgttctttacatttgt

SEQ ID NO: 2112 - DNA, 20 bp, synthetic construct
  misc_feature 1..20: note = Synthetic oligonucleotide
  source 1..20: mol_type = other DNA
ttgtaactttccactagtct

SEQ ID NO: 2113 - DNA, 20 bp, synthetic construct
  misc_feature 1..20: note = Synthetic oligonucleotide
  source 1..20: mol_type = other DNA
tgcttttctttaaatgataa

SEQ ID NO: 2114 - DNA, 20 bp, synthetic construct
  misc_feature 1..20: note = Synthetic oligonucleotide
  source 1..20: mol_type = other DNA
ttatcacattccaataaata

SEQ ID NO: 2115 - DNA, 20 bp, synthetic construct
  misc_feature 1..20: note = Synthetic oligonucleotide
  source 1..20: mol_type = other DNA
ctacattttatcctttccta

SEQ ID NO: 2116 - DNA, 20 bp, synthetic construct
  misc_feature 1..20: note = Synthetic oligonucleotide
  source 1..20: mol_type = other DNA
tcaaacatctatacttgatc

SEQ ID NO: 2117 - DNA, 20 bp, synthetic construct
  misc_feature 1..20: note = Synthetic oligonucleotide
  source 1..20: mol_type = other DNA
ttaggatatggagttaaacc

SEQ ID NO: 2118 - DNA, 20 bp, synthetic construct
  misc_feature 1..20: note = Synthetic oligonucleotide
  source 1..20: mol_type = other DNA
cctatattttcttctagtac

SEQ ID NO: 2119 - DNA, 20 bp, synthetic construct
  misc_feature 1..20: note = Synthetic oligonucleotide
  source 1..20: mol_type = other DNA
ggtctttgctcataatacca

SEQ ID NO: 2120 - DNA, 20 bp, synthetic construct
  misc_feature 1..20: note = Synthetic oligonucleotide
  source 1..20: mol_type = other DNA
tctaacttattccttagtta

SEQ ID NO: 2121 - DNA, 20 bp, synthetic construct
  misc_feature 1..20: note = Synthetic oligonucleotide
  source 1..20: mol_type = other DNA
gtacaatttttaaactaggc

SEQ ID NO: 2122 - DNA, 20 bp, synthetic construct
  misc_feature 1..20: note = Synthetic oligonucleotide
  source 1..20: mol_type = other DNA
gctttcatttccatccttta

SEQ ID NO: 2123 - DNA, 20 bp, synthetic construct
  misc_feature 1..20: note = Synthetic oligonucleotide
  source 1..20: mol_type = other DNA
ttccatttccttcctttttc

SEQ ID NO: 2124 - DNA, 20 bp, synthetic construct
  misc_feature 1..20: note = Synthetic oligonucleotide
  source 1..20: mol_type = other DNA
caagtctattttcttatcaa

SEQ ID NO: 2125 - DNA, 20 bp, synthetic construct
  misc_feature 1..20: note = Synthetic oligonucleotide
  source 1..20: mol_type = other DNA
gtatcaattataattagaac

SEQ ID NO: 2126 - DNA, 20 bp, synthetic construct
  misc_feature 1..20: note = Synthetic oligonucleotide
  source 1..20: mol_type = other DNA
aaaatgtgtagctcaataac

SEQ ID NO: 2127 - DNA, 20 bp, synthetic construct
  misc_feature 1..20: note = Synthetic oligonucleotide
  source 1..20: mol_type = other DNA
atttaatgaatattttccca

SEQ ID NO: 2128 - DNA, 20 bp, synthetic construct
  misc_feature 1..20: note = Synthetic oligonucleotide
  source 1..20: mol_type = other DNA
acagcatctatatacctcta

SEQ ID NO: 2129 - DNA, 20 bp, synthetic construct
  misc_feature 1..20: note = Synthetic oligonucleotide
  source 1..20: mol_type = other DNA
tagttcagcattactagtgt

SEQ ID NO: 2130 - DNA, 20 bp, synthetic construct
  misc_feature 1..20: note = Synthetic oligonucleotide
  source 1..20: mol_type = other DNA
tggtttcttaccattaataa

SEQ ID NO: 2131 - DNA, 20 bp, synthetic construct
  misc_feature 1..20: note = Synthetic oligonucleotide
  source 1..20: mol_type = other DNA
ttttccttatttcatggcta

SEQ ID NO: 2132 - DNA, 20 bp, synthetic construct
  misc_feature 1..20: note = Synthetic oligonucleotide
  source 1..20: mol_type = other DNA
cctctctttttctttagtac

SEQ ID NO: 2133 - DNA, 20 bp, synthetic construct
  misc_feature 1..20: note = Synthetic oligonucleotide
  source 1..20: mol_type = other DNA
gtacttacatatcttatcaa

SEQ ID NO: 2134 - DNA, 20 bp, synthetic construct
  misc_feature 1..20: note = Synthetic oligonucleotide
  source 1..20: mol_type = other DNA
tttagtcaaaacaataataa

SEQ ID NO: 2135 - DNA, 20 bp, synthetic construct
  misc_feature 1..20: note = Synthetic oligonucleotide
  source 1..20: mol_type = other DNA
gtattataacatcattctaa

SEQ ID NO: 2136 - DNA, 20 bp, synthetic construct
  misc_feature 1..20: note = Synthetic oligonucleotide
  source 1..20: mol_type = other DNA
tgcagtaatttacacaacta

SEQ ID NO: 2137 - DNA, 20 bp, synthetic construct
  misc_feature 1..20: note = Synthetic oligonucleotide
  source 1..20: mol_type = other DNA
gataatttccattatatata

SEQ ID NO: 2138 - DNA, 20 bp, synthetic construct
  misc_feature 1..20: note = Synthetic oligonucleotide
  source 1..20: mol_type = other DNA
gttgcatcaaccaaataggg

SEQ ID NO: 2139 - DNA, 20 bp, synthetic construct
  misc_feature 1..20: note = Synthetic oligonucleotide
  source 1..20: mol_type = other DNA
ttctctattttacattgaac

SEQ ID NO: 2140 - DNA, 20 bp, synthetic construct
  misc_feature 1..20: note = Synthetic oligonucleotide
  source 1..20: mol_type = other DNA
actgtgtttttaaattttcc

SEQ ID NO: 2141 - DNA, 20 bp, synthetic construct
  misc_feature 1..20: note = Synthetic oligonucleotide
  source 1..20: mol_type = other DNA
agagaacaaatattgaataa

SEQ ID NO: 2142 - DNA, 20 bp, synthetic construct
  misc_feature 1..20: note = Synthetic oligonucleotide
  source 1..20: mol_type = other DNA
aaggcattcttcataggcaa

SEQ ID NO: 2143 - DNA, 20 bp, synthetic construct
  misc_feature 1..20: note = Synthetic oligonucleotide
  source 1..20: mol_type = other DNA
tagttattttttaaagcctt

SEQ ID NO: 2144 - DNA, 20 bp, synthetic construct
  misc_feature 1..20: note = Synthetic oligonucleotide
  source 1..20: mol_type = other DNA
gcatttatcattacactctt

SEQ ID NO: 2145 - DNA, 20 bp, synthetic construct
  misc_feature 1..20: note = Synthetic oligonucleotide
  source 1..20: mol_type = other DNA
ttatgcctaaacatcatcat

SEQ ID NO: 2146 - DNA, 20 bp, synthetic construct
  misc_feature 1..20: note = Synthetic oligonucleotide
  source 1..20: mol_type = other DNA
ttaagttctaaaataaaatc

SEQ ID NO: 2147 - DNA, 20 bp, synthetic construct
  misc_feature 1..20: note = Synthetic oligonucleotide
  source 1..20: mol_type = other DNA
ctactaatcaacatttgcca

SEQ ID NO: 2148 - DNA, 20 bp, synthetic construct
  misc_feature 1..20: note = Synthetic oligonucleotide
  source 1..20: mol_type = other DNA
tctctacatttctcatttaa

SEQ ID NO: 2149 - DNA, 20 bp, synthetic construct
  misc_feature 1..20: note = Synthetic oligonucleotide
  source 1..20: mol_type = other DNA
taagcattttatacttgtat

SEQ ID NO: 2150 - DNA, 20 bp, synthetic construct
  misc_feature 1..20: note = Synthetic oligonucleotide
  source 1..20: mol_type = other DNA
ttttcaatttcacataggtt

SEQ ID NO: 2151 - DNA, 20 bp, synthetic construct
  misc_feature 1..20: note = Synthetic oligonucleotide
  source 1..20: mol_type = other DNA
atgtcttcttccattcttta

SEQ ID NO: 2152 - DNA, 20 bp, synthetic construct
  misc_feature 1..20: note = Synthetic oligonucleotide
  source 1..20: mol_type = other DNA
ctgattctcccattatataa

SEQ ID NO: 2153 - DNA, 20 bp, synthetic construct
  misc_feature 1..20: note = Synthetic oligonucleotide
  source 1..20: mol_type = other DNA
atggaatctctctctaccta

SEQ ID NO: 2154 - DNA, 20 bp, synthetic construct
  misc_feature 1..20: note = Synthetic oligonucleotide
  source 1..20: mol_type = other DNA
gaacaattccataattcttt

SEQ ID NO: 2155 - DNA, 20 bp, synthetic construct
  misc_feature 1..20: note = Synthetic oligonucleotide
  source 1..20: mol_type = other DNA
acttcatatttaaagcataa

SEQ ID NO: 2156 - DNA, 20 bp, synthetic construct
  misc_feature 1..20: note = Synthetic oligonucleotide
  source 1..20: mol_type = other DNA
gtcttttctcctaattgtga

SEQ ID NO: 2157 - DNA, 20 bp, synthetic construct
  misc_feature 1..20: note = Synthetic oligonucleotide
  source 1..20: mol_type = other DNA
attttacattctataatgta

SEQ ID NO: 2158 - DNA, 20 bp, synthetic construct
  misc_feature 1..20: note = Synthetic oligonucleotide
  source 1..20: mol_type = other DNA
cctattcatttacattatta

SEQ ID NO: 2159 - DNA, 20 bp, synthetic construct
  misc_feature 1..20: note = Synthetic oligonucleotide
  source 1..20: mol_type = other DNA
gcctagttaaaatttaacaa

SEQ ID NO: 2160 - DNA, 20 bp, synthetic construct
  misc_feature 1..20: note = Synthetic oligonucleotide
  source 1..20: mol_type = other DNA
atatagttcaatacaaggaa

SEQ ID NO: 2161 - DNA, 20 bp, synthetic construct
  misc_feature 1..20: note = Synthetic oligonucleotide
  source 1..20: mol_type = other DNA
cttttgttttcctttaggtt

SEQ ID NO: 2162 - DNA, 20 bp, synthetic construct
  misc_feature 1..20: note = Synthetic oligonucleotide
  source 1..20: mol_type = other DNA
catatttcttctcattctta

SEQ ID NO: 2163 - DNA, 20 bp, synthetic construct
  misc_feature 1..20: note = Synthetic oligonucleotide
  source 1..20: mol_type = other DNA
aagtcaaaaaattctattaa

SEQ ID NO: 2164 - DNA, 20 bp, synthetic construct
  misc_feature 1..20: note = Synthetic oligonucleotide
  source 1..20: mol_type = other DNA
catctggtaaatattatttt

SEQ ID NO: 2165 - DNA, 20 bp, synthetic construct
  misc_feature 1..20: note = Synthetic oligonucleotide
  source 1..20: mol_type = other DNA
catttttattttaattgctt

SEQ ID NO: 2166 - DNA, 20 bp, synthetic construct
  misc_feature 1..20: note = Synthetic oligonucleotide
  source 1..20: mol_type = other DNA
tgcataatacataaatgcaa

SEQ ID NO: 2167 - DNA, 20 bp, synthetic construct
  misc_feature 1..20: note = Synthetic oligonucleotide
  source 1..20: mol_type = other DNA
ttacagcaggtcgaggtatg

SEQ ID NO: 2168 - DNA, 20 bp, synthetic construct
  misc_feature 1..20: note = Synthetic oligonucleotide
  source 1..20: mol_type = other DNA
gtctggacatttcataggct

SEQ ID NO: 2169 - DNA, 20 bp, synthetic construct
  misc_feature 1..20: note = Synthetic oligonucleotide
  source 1..20: mol_type = other DNA
tttctgactttatattctct

SEQ ID NO: 2170 - DNA, 20 bp, synthetic construct
  misc_feature 1..20: note = Synthetic oligonucleotide
  source 1..20: mol_type = other DNA
cagatctcaaatcttacctc

SEQ ID NO: 2171 - DNA, 20 bp, synthetic construct
  misc_feature 1..20: note = Synthetic oligonucleotide
  source 1..20: mol_type = other DNA
gccatcttttcatcctgctc

SEQ ID NO: 2172 - DNA, 20 bp, synthetic construct
  misc_feature 1..20: note = Synthetic oligonucleotide
  source 1..20: mol_type = other DNA
agctaattttctaatagggt

SEQ ID NO: 2173 - DNA, 20 bp, synthetic construct
  misc_feature 1..20: note = Synthetic oligonucleotide
  source 1..20: mol_type = other DNA
tcctcaatatattcatccca

SEQ ID NO: 2174 - DNA, 20 bp, synthetic construct
  misc_feature 1..20: note = Synthetic oligonucleotide
  source 1..20: mol_type = other DNA
cgtctctttcttatttctgt

SEQ ID NO: 2175 - DNA, 20 bp, synthetic construct
  misc_feature 1..20: note = Synthetic oligonucleotide
  source 1..20: mol_type = other DNA
ggtgtttcacctttaaccat

SEQ ID NO: 2176 - DNA, 20 bp, synthetic construct
  misc_feature 1..20: note = Synthetic oligonucleotide
  source 1..20: mol_type = other DNA
atggttggaaatacagctgt

SEQ ID NO: 2177 - DNA, 20 bp, synthetic construct
  misc_feature 1..20: note = Synthetic oligonucleotide
  source 1..20: mol_type = other DNA
ctcaatgtatatatcttcaa

SEQ ID NO: 2178 - DNA, 20 bp, synthetic construct
  misc_feature 1..20: note = Synthetic oligonucleotide
  source 1..20: mol_type = other DNA
tcacatttttccacctggca

SEQ ID NO: 2179 - DNA, 20 bp, synthetic construct
  misc_feature 1..20: note = Synthetic oligonucleotide
  source 1..20: mol_type = other DNA
tacttgatacctttttaact

SEQ ID NO: 2180 - DNA, 20 bp, synthetic construct
  misc_feature 1..20: note = Synthetic oligonucleotide
  source 1..20: mol_type = other DNA
gtgacaattactattatcaa

SEQ ID NO: 2181 - DNA, 20 bp, synthetic construct
  misc_feature 1..20: note = Synthetic oligonucleotide
  source 1..20: mol_type = other DNA
atatttttattttatgccaa

SEQ ID NO: 2182 - DNA, 20 bp, synthetic construct
  misc_feature 1..20: note = Synthetic oligonucleotide
  source 1..20: mol_type = other DNA
ggtaaaattactatttacaa

SEQ ID NO: 2183 - DNA, 20 bp, synthetic construct
  misc_feature 1..20: note = Synthetic oligonucleotide
  source 1..20: mol_type = other DNA
aaccaattacatcatattac

SEQ ID NO: 2184 - DNA, 20 bp, synthetic construct
  misc_feature 1..20: note = Synthetic oligonucleotide
  source 1..20: mol_type = other DNA
ctacactgcatcctagtcct

SEQ ID NO: 2185 - DNA, 20 bp, synthetic construct
  misc_feature 1..20: note = Synthetic oligonucleotide
  source 1..20: mol_type = other DNA
gtaatataacttcactacct

SEQ ID NO: 2186 - DNA, 20 bp, synthetic construct
  misc_feature 1..20: note = Synthetic oligonucleotide
  source 1..20: mol_type = other DNA
gtaacagcattttcctgcat

SEQ ID NO: 2187 - DNA, 20 bp, synthetic construct
  misc_feature 1..20: note = Synthetic oligonucleotide
  source 1..20: mol_type = other DNA
attatagtaattaatgtgtg

SEQ ID NO: 2188 - DNA, 20 bp, synthetic construct
  misc_feature 1..20: note = Synthetic oligonucleotide
  source 1..20: mol_type = other DNA
atttttgtaactttccacta

SEQ ID NO: 2189 - DNA, 20 bp, synthetic construct
  misc_feature 1..20: note = Synthetic oligonucleotide
  source 1..20: mol_type = other DNA
ttgcttttctttaaatgata

SEQ ID NO: 2190 - DNA, 20 bp, synthetic construct
  misc_feature 1..20: note = Synthetic oligonucleotide
  source 1..20: mol_type = other DNA
ttatagttttttaccctcaa

SEQ ID NO: 2191 - DNA, 20 bp, synthetic construct
  misc_feature 1..20: note = Synthetic oligonucleotide
  source 1..20: mol_type = other DNA
tcaaatcattctacaattca

SEQ ID NO: 2192 - DNA, 20 bp, synthetic construct
  misc_feature 1..20: note = Synthetic oligonucleotide
  source 1..20: mol_type = other DNA
catttatttataaattataa

SEQ ID NO: 2193 - DNA, 20 bp, synthetic construct
  misc_feature 1..20: note = Synthetic oligonucleotide
  source 1..20: mol_type = other DNA
attgttaggatatggagtta

SEQ ID NO: 2194 - DNA, 20 bp, synthetic construct
  misc_feature 1..20: note = Synthetic oligonucleotide
  source 1..20: mol_type = other DNA
ggagtttcttacatatttta

SEQ ID NO: 2195 - DNA, 20 bp, synthetic construct
  misc_feature 1..20: note = Synthetic oligonucleotide
  source 1..20: mol_type = other DNA
aattctctccaaaataatta

SEQ ID NO: 2196 - DNA, 20 bp, synthetic construct
  misc_feature 1..20: note = Synthetic oligonucleotide
  source 1..20: mol_type = other DNA
accatctaacttattcctta

SEQ ID NO: 2197 - DNA, 20 bp, synthetic construct
  misc_feature 1..20: note = Synthetic oligonucleotide
  source 1..20: mol_type = other DNA
tggagcttatattctaggta

SEQ ID NO: 2198 - DNA, 20 bp, synthetic construct
  misc_feature 1..20: note = Synthetic oligonucleotide
  source 1..20: mol_type = other DNA
atatttttaaaaacttggct

SEQ ID NO: 2199 - DNA, 20 bp, synthetic construct
  misc_feature 1..20: note = Synthetic oligonucleotide
  source 1..20: mol_type = other DNA
ttaaatatttccatttcctt

SEQ ID NO: 2200 - DNA, 20 bp, synthetic construct
  misc_feature 1..20: note = Synthetic oligonucleotide
  source 1..20: mol_type = other DNA
ctttcttattccataggttc

SEQ ID NO: 2201 - DNA, 20 bp, synthetic construct
  misc_feature 1..20: note = Synthetic oligonucleotide
  source 1..20: mol_type = other DNA
ttcattatccttatttgcaa

SEQ ID NO: 2202 - DNA, 20 bp, synthetic construct
  misc_feature 1..20: note = Synthetic oligonucleotide
  source 1..20: mol_type = other DNA
aagaacacataacattgcca

SEQ ID NO: 2203 - DNA, 20 bp, synthetic construct
  misc_feature 1..20: note = Synthetic oligonucleotide
  source 1..20: mol_type = other DNA
acttatttatttaatgaata

SEQ ID NO: 2204 - DNA, 20 bp, synthetic construct
  misc_feature 1..20: note = Synthetic oligonucleotide
  source 1..20: mol_type = other DNA
tacagcatctatatacctct

SEQ ID NO: 2205 - DNA, 20 bp, synthetic construct
  misc_feature 1..20: note = Synthetic oligonucleotide
  source 1..20: mol_type = other DNA
ccattttcaaatgataggta

SEQ ID NO: 2206 - DNA, 20 bp, synthetic construct
  misc_feature 1..20: note = Synthetic oligonucleotide
  source 1..20: mol_type = other DNA
gtcattatccactaagataa

SEQ ID NO: 2207 - DNA, 20 bp, synthetic construct
  misc_feature 1..20: note = Synthetic oligonucleotide
  source 1..20: mol_type = other DNA
caggcattttccttatttca

SEQ ID NO: 2208 - DNA, 20 bp, synthetic construct
  misc_feature 1..20: note = Synthetic oligonucleotide
  source 1..20: mol_type = other DNA
aaatgtcacctctctttttc

SEQ ID NO: 2209 - DNA, 20 bp, synthetic construct
  misc_feature 1..20: note = Synthetic oligonucleotide
  source 1..20: mol_type = other DNA
tgtacttacatatcttatca

SEQ ID NO: 2210 - DNA, 20 bp, synthetic construct
  misc_feature 1..20: note = Synthetic oligonucleotide
  source 1..20: mol_type = other DNA
ataatgaaatatcaacacta

SEQ ID NO: 2211 - DNA, 20 bp, synthetic construct
  misc_feature 1..20: note = Synthetic oligonucleotide
  source 1..20: mol_type = other DNA
aagtaattaattaaatgtat

SEQ ID NO: 2212 - DNA, 20 bp, synthetic construct
  misc_feature 1..20: note = Synthetic oligonucleotide
  source 1..20: mol_type = other DNA
ttgtatttcataaaatatgc

SEQ ID NO: 2213 - DNA, 20 bp, synthetic construct
  misc_feature 1..20: note = Synthetic oligonucleotide
  source 1..20: mol_type = other DNA
gagataatttccattatata

SEQ ID NO: 2214 - DNA, 20 bp, synthetic construct
  misc_feature 1..20: note = Synthetic oligonucleotide
  source 1..20: mol_type = other DNA
atgttgcatcaaccaaatag

SEQ ID NO: 2215 - DNA, 20 bp, synthetic construct
  misc_feature 1..20: note = Synthetic oligonucleotide
  source 1..20: mol_type = other DNA
attctctattttacattgaa

SEQ ID NO: 2216 - DNA, 20 bp, synthetic construct
  misc_feature 1..20: note = Synthetic oligonucleotide
  source 1..20: mol_type = other DNA
tggctctaaaatcttgctaa

SEQ ID NO: 2217 - DNA, 20 bp, synthetic construct
  misc_feature 1..20: note = Synthetic oligonucleotide
  source 1..20: mol_type = other DNA
atgtaacccacaaacttgca

SEQ ID NO: 2218 - DNA, 20 bp, synthetic construct
  misc_feature 1..20: note = Synthetic oligonucleotide
  source 1..20: mol_type = other DNA
aaaggcattcttcataggca

SEQ ID NO: 2219 - DNA, 20 bp, synthetic construct
  misc_feature 1..20: note = Synthetic oligonucleotide
  source 1..20: mol_type = other DNA
gtagttattttttaaagcct

SEQ ID NO: 2220 - DNA, 20 bp, synthetic construct
  misc_feature 1..20: note = Synthetic oligonucleotide
  source 1..20: mol_type = other DNA
taagcatttatcattacact

SEQ ID NO: 2221 - DNA, 20 bp, synthetic construct
  misc_feature 1..20: note = Synthetic oligonucleotide
  source 1..20: mol_type = other DNA
cattcaacaaccttatgcct

SEQ ID NO: 2222 - DNA, 20 bp, synthetic construct
  misc_feature 1..20: note = Synthetic oligonucleotide
  source 1..20: mol_type = other DNA
tttaagttctaaaataaaat

SEQ ID NO: 2223 - DNA, 20 bp, synthetic construct
  misc_feature 1..20: note = Synthetic oligonucleotide
  source 1..20: mol_type = other DNA
aatgtttcttctactaatca

SEQ ID NO: 2224 - DNA, 20 bp, synthetic construct
  misc_feature 1..20: note = Synthetic oligonucleotide
  source 1..20: mol_type = other DNA
ccatctctctacatttctca

SEQ ID NO: 2225 - DNA, 20 bp, synthetic construct
  misc_feature 1..20: note = Synthetic oligonucleotide
  source 1..20: mol_type = other DNA
atacagacaatttatagtaa

SEQ ID NO: 2226 - DNA, 20 bp, synthetic construct
  misc_feature 1..20: note = Synthetic oligonucleotide
  source 1..20: mol_type = other DNA
aggaatttttcaatttcaca

SEQ ID NO: 2227 - DNA, 20 bp, synthetic construct
  misc_feature 1..20: note = Synthetic oligonucleotide
  source 1..20: mol_type = other DNA
tcctttacatatattagata

SEQ ID NO: 2228 - DNA, 20 bp, synthetic construct
  misc_feature 1..20: note = Synthetic oligonucleotide
  source 1..20: mol_type = other DNA
tctgattctcccattatata

SEQ ID NO: 2229 - DNA, 20 bp, synthetic construct
  misc_feature 1..20: note = Synthetic oligonucleotide
  source 1..20: mol_type = other DNA
ccaaaattcatcttactgct

SEQ ID NO: 2230 - DNA, 20 bp, synthetic construct
  misc_feature 1..20: note = Synthetic oligonucleotide
  source 1..20: mol_type = other DNA
atgaacaattccataattct

SEQ ID NO: 2231 - DNA, 20 bp, synthetic construct
  misc_feature 1..20: note = Synthetic oligonucleotide
  source 1..20: mol_type = other DNA
gtgtaattacttcatattta

SEQ ID NO: 2232 - DNA, 20 bp, synthetic construct
  misc_feature 1..20: note = Synthetic oligonucleotide
  source 1..20: mol_type = other DNA
ttatttctcacaactctata

SEQ ID NO: 2233 - DNA, 20 bp, synthetic construct
  misc_feature 1..20: note = Synthetic oligonucleotide
  source 1..20: mol_type = other DNA
attcagaattttacattcta

SEQ ID NO: 2234 - DNA, 20 bp, synthetic construct
  misc_feature 1..20: note = Synthetic oligonucleotide
  source 1..20: mol_type = other DNA
gcagataaatattataccca

SEQ ID NO: 2235 - DNA, 20 bp, synthetic construct
  misc_feature 1..20: note = Synthetic oligonucleotide
  source 1..20: mol_type = other DNA
cactttttaattacctgtac

SEQ ID NO: 2236 - DNA, 20 bp, synthetic construct
  misc_feature 1..20: note = Synthetic oligonucleotide
  source 1..20: mol_type = other DNA
atggataatacaccaatata

SEQ ID NO: 2237 - DNA, 20 bp, synthetic construct
  misc_feature 1..20: note = Synthetic oligonucleotide
  source 1..20: mol_type = other DNA
catttggaaactacttgtta

SEQ ID NO: 2238 - DNA, 20 bp, synthetic construct
  misc_feature 1..20: note = Synthetic oligonucleotide
  source 1..20: mol_type = other DNA
ttgtacaaactcattcctcc

SEQ ID NO: 2239 - DNA, 20 bp, synthetic construct
  misc_feature 1..20: note = Synthetic oligonucleotide
  source 1..20: mol_type = other DNA
tgtaagtcaaaaaattctat

SEQ ID NO: 2240 - DNA, 20 bp, synthetic construct
  misc_feature 1..20: note = Synthetic oligonucleotide
  source 1..20: mol_type = other DNA
aagaagtgaaaatctagcta

SEQ ID NO: 2241 - DNA, 20 bp, synthetic construct
  misc_feature 1..20: note = Synthetic oligonucleotide
  source 1..20: mol_type = other DNA
tggaaagttttcatttgcaa

SEQ ID NO: 2242 - DNA, 20 bp, synthetic construct
  misc_feature 1..20: note = Synthetic oligonucleotide
  source 1..20: mol_type = other DNA
tacatttctttagataggca

SEQ ID NO: 2243 - DNA, 20 bp, synthetic construct
  misc_feature 1..20: note = Synthetic oligonucleotide
  source 1..20: mol_type = other DNA
taacaggcaatgaaaatatg

SEQ ID NO: 2244 - DNA, 20 bp, synthetic construct
  misc_feature 1..20: note = Synthetic oligonucleotide
  source 1..20: mol_type = other DNA
tctattctaattatttttca

SEQ ID NO: 2245 - DNA, 20 bp, synthetic construct
  misc_feature 1..20: note = Synthetic oligonucleotide
  source 1..20: mol_type = other DNA
aactaataaataaatacttc

SEQ ID NO: 2246 - DNA, 20 bp, synthetic construct
  misc_feature 1..20: note = Synthetic oligonucleotide
  source 1..20: mol_type = other DNA
aggtcagatctcaaatctta

SEQ ID NO: 2247 - DNA, 20 bp, synthetic construct
  misc_feature 1..20: note = Synthetic oligonucleotide
  source 1..20: mol_type = other DNA
ctcttagctttctcttctgc

SEQ ID NO: 2248 - DNA, 20 bp, synthetic construct
  misc_feature 1..20: note = Synthetic oligonucleotide
  source 1..20: mol_type = other DNA
tcaaaagtataaattcctgt

SEQ ID NO: 2249 - DNA, 20 bp, synthetic construct
  misc_feature 1..20: note = Synthetic oligonucleotide
  source 1..20: mol_type = other DNA
atcctcaatatattcatccc

SEQ ID NO: 2250 - DNA, 20 bp, synthetic construct
  misc_feature 1..20: note = Synthetic oligonucleotide
  source 1..20: mol_type = other DNA
accgtctctttcttatttct

SEQ ID NO: 2251 - DNA, 20 bp, synthetic construct
  misc_feature 1..20: note = Synthetic oligonucleotide
  source 1..20: mol_type = other DNA
aggtgtttcacctttaacca

SEQ ID NO: 2252 - DNA, 20 bp, synthetic construct
  misc_feature 1..20: note = Synthetic oligonucleotide
  source 1..20: mol_type = other DNA
tatggttggaaatacagctg

SEQ ID NO: 2253 - DNA, 20 bp, synthetic construct
  misc_feature 1..20: note = Synthetic oligonucleotide
  source 1..20: mol_type = other DNA
ttaatggtttttcgctgctc

SEQ ID NO: 2254 - DNA, 20 bp, synthetic construct
  misc_feature 1..20: note = Synthetic oligonucleotide
  source 1..20: mol_type = other DNA
ttcacatttttccacctggc

SEQ ID NO: 2255 - DNA, 20 bp, synthetic construct
  misc_feature 1..20: note = Synthetic oligonucleotide
  source 1..20: mol_type = other DNA
tttcttgtatatacttgata

SEQ ID NO: 2256 - DNA, 20 bp, synthetic construct
  misc_feature 1..20: note = Synthetic oligonucleotide
  source 1..20: mol_type = other DNA
ggtgacaattactattatca

SEQ ID NO: 2257 - DNA, 20 bp, synthetic construct
  misc_feature 1..20: note = Synthetic oligonucleotide
  source 1..20: mol_type = other DNA
gatatttttattttatgcca

SEQ ID NO: 2258 - DNA, 20 bp, synthetic construct
  misc_feature 1..20: note = Synthetic oligonucleotide
  source 1..20: mol_type = other DNA
gggtaaaattactatttaca

SEQ ID NO: 2259 - DNA, 20 bp, synthetic construct
  misc_feature 1..20: note = Synthetic oligonucleotide
  source 1..20: mol_type = other DNA
gaaccaattacatcatatta

SEQ ID NO: 2260 - DNA, 20 bp, synthetic construct
  misc_feature 1..20: note = Synthetic oligonucleotide
  source 1..20: mol_type = other DNA
atatattttaaacagattta

SEQ ID NO: 2261 - DNA, 20 bp, synthetic construct
  misc_feature 1..20: note = Synthetic oligonucleotide
  source 1..20: mol_type = other DNA
ctggtaatataacttcacta

SEQ ID NO: 2262 - DNA, 20 bp, synthetic construct
  misc_feature 1..20: note = Synthetic oligonucleotide
  source 1..20: mol_type = other DNA
tttaccgttctttatggtaa

SEQ ID NO: 2263 - DNA, 20 bp, synthetic construct
  misc_feature 1..20: note = Synthetic oligonucleotide
  source 1..20: mol_type = other DNA
aagatgaattatagtaatta

SEQ ID NO: 2264 - DNA, 20 bp, synthetic construct
  misc_feature 1..20: note = Synthetic oligonucleotide
  source 1..20: mol_type = other DNA
ttaatttttgtaactttcca

SEQ ID NO: 2265 - DNA, 20 bp, synthetic construct
  misc_feature 1..20: note = Synthetic oligonucleotide
  source 1..20: mol_type = other DNA
ccttatctctcaattacaat

SEQ ID NO: 2266 - DNA, 20 bp, synthetic construct
  misc_feature 1..20: note = Synthetic oligonucleotide
  source 1..20: mol_type = other DNA
aagatcattttatcccccta

SEQ ID NO: 2267 - DNA, 20 bp, synthetic construct
  misc_feature 1..20: note = Synthetic oligonucleotide
  source 1..20: mol_type = other DNA
cttatggtctttaataataa

SEQ ID NO: 2268 - DNA, 20 bp, synthetic construct
  misc_feature 1..20: note = Synthetic oligonucleotide
  source 1..20: mol_type = other DNA
tcacatttatttataaatta

SEQ ID NO: 2269 - DNA, 20 bp, synthetic construct
  misc_feature 1..20: note = Synthetic oligonucleotide
  source 1..20: mol_type = other DNA
taattgttaggatatggagt

SEQ ID NO: 2270 - DNA, 20 bp, synthetic construct
  misc_feature 1..20: note = Synthetic oligonucleotide
  source 1..20: mol_type = other DNA
gagaaatgtccatttaggtc

SEQ ID NO: 2271 - DNA, 20 bp, synthetic construct
  misc_feature 1..20: note = Synthetic oligonucleotide
  source 1..20: mol_type = other DNA
agcacaagtccaattaggcc

SEQ ID NO: 2272 - DNA, 20 bp, synthetic construct
  misc_feature 1..20: note = Synthetic oligonucleotide
  source 1..20: mol_type = other DNA
tttaatcaccatctaactta

SEQ ID NO: 2273 - DNA, 20 bp, synthetic construct
  misc_feature 1..20: note = Synthetic oligonucleotide
  source 1..20: mol_type = other DNA
gctaatcatttaacaaaaat

SEQ ID NO: 2274 - DNA, 20 bp, synthetic construct
  misc_feature 1..20: note = Synthetic oligonucleotide
  source 1..20: mol_type = other DNA
attttatatataattactaa

SEQ ID NO: 2275 - DNA, 20 bp, synthetic construct
  misc_feature 1..20: note = Synthetic oligonucleotide
  source 1..20: mol_type = other DNA
gaacttatcttccttagaaa

SEQ ID NO: 2276 - DNA, 20 bp, synthetic construct
  misc_feature 1..20: note = Synthetic oligonucleotide
  source 1..20: mol_type = other DNA
acataattttatattagttt

SEQ ID NO: 2277 - DNA, 20 bp, synthetic construct
  misc_feature 1..20: note = Synthetic oligonucleotide
  source 1..20: mol_type = other DNA
gctaggctttcaattaatat

SEQ ID NO: 2278 - DNA, 20 bp, synthetic construct
  misc_feature 1..20: note = Synthetic oligonucleotide
  source 1..20: mol_type = other DNA
cctgtgatctcattttgcaa

SEQ ID NO: 2279 - DNA, 20 bp, synthetic construct
  misc_feature 1..20: note = Synthetic oligonucleotide
  source 1..20: mol_type = other DNA
actagtcacttatttattta

SEQ ID NO: 2280 - DNA, 20 bp, synthetic construct
  misc_feature 1..20: note = Synthetic oligonucleotide
  source 1..20: mol_type = other DNA
ctacagcatctatatacctc

SEQ ID NO: 2281 - DNA, 20 bp, synthetic construct
  misc_feature 1..20: note = Synthetic oligonucleotide
  source 1..20: mol_type = other DNA
cctaccattttcaaatgata

SEQ ID NO: 2282 - DNA, 20 bp, synthetic construct
  misc_feature 1..20: note = Synthetic oligonucleotide
  source 1..20: mol_type = other DNA
agtcattatccactaagata

SEQ ID NO: 2283 - DNA, 20 bp, synthetic construct
  misc_feature 1..20: note = Synthetic oligonucleotide
  source 1..20: mol_type = other DNA
acaggcattttccttatttc

SEQ ID NO: 2284 - DNA, 20 bp, synthetic construct
  misc_feature 1..20: note = Synthetic oligonucleotide
  source 1..20: mol_type = other DNA
tactgtaattattttaggtt

SEQ ID NO: 2285 - DNA, 20 bp, synthetic construct
  misc_feature 1..20: note = Synthetic oligonucleotide
  source 1..20: mol_type = other DNA
atctgtacttacatatctta

SEQ ID NO: 2286 - DNA, 20 bp, synthetic construct
  misc_feature 1..20: note = Synthetic oligonucleotide
  source 1..20: mol_type = other DNA
atcacattacttacacataa

SEQ ID NO: 2287 - DNA, 20 bp, synthetic construct
  misc_feature 1..20: note = Synthetic oligonucleotide
  source 1..20: mol_type = other DNA
attcaagtaattaattaaat

SEQ ID NO: 2288 - DNA, 20 bp, synthetic construct
  misc_feature 1..20: note = Synthetic oligonucleotide
  source 1..20: mol_type = other DNA
attaattaatttaaaggatc

SEQ ID NO: 2289 - DNA, 20 bp, synthetic construct
  misc_feature 1..20: note = Synthetic oligonucleotide
  source 1..20: mol_type = other DNA
acttgattcacatctaaatt

SEQ ID NO: 2290 - DNA, 20 bp, synthetic construct
  misc_feature 1..20: note = Synthetic oligonucleotide
  source 1..20: mol_type = other DNA
gcatatgtactcaatacata

SEQ ID NO: 2291 - DNA, 20 bp, synthetic construct
  misc_feature 1..20: note = Synthetic oligonucleotide
  source 1..20: mol_type = other DNA
tttattctctattttacatt

SEQ ID NO: 2292 - DNA, 20 bp, synthetic construct
  misc_feature 1..20: note = Synthetic oligonucleotide
  source 1..20: mol_type = other DNA
gtggctctaaaatcttgcta

SEQ ID NO: 2293 - DNA, 20 bp, synthetic construct
  misc_feature 1..20: note = Synthetic oligonucleotide
  source 1..20: mol_type = other DNA
ctttattacatatttaggaa

SEQ ID NO: 2294 - DNA, 20 bp, synthetic construct
  misc_feature 1..20: note = Synthetic oligonucleotide
  source 1..20: mol_type = other DNA
ttaaaggcattcttcatagg

SEQ ID NO: 2295 - DNA, 20 bp, synthetic construct
  misc_feature 1..20: note = Synthetic oligonucleotide
  source 1..20: mol_type = other DNA
gtgattctattcattattta

SEQ ID NO: 2296 - DNA, 20 bp, synthetic construct
  misc_feature 1..20: note = Synthetic oligonucleotide
  source 1..20: mol_type = other DNA
cttagcatcatcataagtat

SEQ ID NO: 2297 - DNA, 20 bp, synthetic construct
  misc_feature 1..20: note = Synthetic oligonucleotide
  source 1..20: mol_type = other DNA
atttaatccattcaacaacc

SEQ ID NO: 2298 - DNA, 20 bp, synthetic construct
  misc_feature 1..20: note = Synthetic oligonucleotide
  source 1..20: mol_type = other DNA
gtttaagttctaaaataaaa

SEQ ID NO: 2299 - DNA, 20 bp, synthetic construct
  misc_feature 1..20: note = Synthetic oligonucleotide
  source 1..20: mol_type = other DNA
tcagtcactttaatactatt

SEQ ID NO: 2300 - DNA, 20 bp, synthetic construct
  misc_feature 1..20: note = Synthetic oligonucleotide
  source 1..20: mol_type = other DNA
ttccatctctctacatttct

SEQ ID NO: 2301 - DNA, 20 bp, synthetic construct
  misc_feature 1..20: note = Synthetic oligonucleotide
  source 1..20: mol_type = other DNA
ttcagaccttccatttctct

SEQ ID NO: 2302 - DNA, 20 bp, synthetic construct
  misc_feature 1..20: note = Synthetic oligonucleotide
  source 1..20: mol_type = other DNA
cgcttgttactccctaggaa

SEQ ID NO: 2303 - DNA, 20 bp, synthetic construct
  misc_feature 1..20: note = Synthetic oligonucleotide
  source 1..20: mol_type = other DNA
ataatcctttacatatatta

SEQ ID NO: 2304 - DNA, 20 bp, synthetic construct
  misc_feature 1..20: note = Synthetic oligonucleotide
  source 1..20: mol_type = other DNA
tccattctttctattttctc

SEQ ID NO: 2305 - DNA, 20 bp, synthetic construct
  misc_feature 1..20: note = Synthetic oligonucleotide
  source 1..20: mol_type = other DNA
ccaggcatctcaaattcaac

SEQ ID NO: 2306 - DNA, 20 bp, synthetic construct
  misc_feature 1..20: note = Synthetic oligonucleotide
  source 1..20: mol_type = other DNA
actttctttaaaattaacaa

SEQ ID NO: 2307 - DNA, 20 bp, synthetic construct
  misc_feature 1..20: note = Synthetic oligonucleotide
  source 1..20: mol_type = other DNA
agtcatttttctattccatt

SEQ ID NO: 2308 - DNA, 20 bp, synthetic construct
  misc_feature 1..20: note = Synthetic oligonucleotide
  source 1..20: mol_type = other DNA
ctcttagtaaataccagtta

SEQ ID NO: 2309 - DNA, 20 bp, synthetic construct
  misc_feature 1..20: note = Synthetic oligonucleotide
  source 1..20: mol_type = other DNA
tttaaattcctctctttacc

SEQ ID NO: 2310 - DNA, 20 bp, synthetic construct
  misc_feature 1..20: note = Synthetic oligonucleotide
  source 1..20: mol_type = other DNA
aagcagataaatattatacc

SEQ ID NO: 2311 - DNA, 20 bp, synthetic construct
  misc_feature 1..20: note = Synthetic oligonucleotide
  source 1..20: mol_type = other DNA
gtgaaatactacattagtaa

SEQ ID NO: 2312 - DNA, 20 bp, synthetic construct
  misc_feature 1..20: note = Synthetic oligonucleotide
  source 1..20: mol_type = other DNA
tatggataatacaccaatat

SEQ ID NO: 2313 - DNA, 20 bp, synthetic construct
  misc_feature 1..20: note = Synthetic oligonucleotide
  source 1..20: mol_type = other DNA
ttctaattccaaaaagagca

SEQ ID NO: 2314 - DNA, 20 bp, synthetic construct
  misc_feature 1..20: note = Synthetic oligonucleotide
  source 1..20: mol_type = other DNA
tagcgaatcagtgtgaagaa

SEQ ID NO: 2315 - DNA, 20 bp, synthetic construct
  misc_feature 1..20: note = Synthetic oligonucleotide
  source 1..20: mol_type = other DNA
gtatatatcttcaaaggcct

SEQ ID NO: 2316 - DNA, 20 bp, synthetic construct
  misc_feature 1..20: note = Synthetic oligonucleotide
  source 1..20: mol_type = other DNA
cttgattcaaatcagcagca

SEQ ID NO: 2317 - DNA, 20 bp, synthetic construct
  misc_feature 1..20: note = Synthetic oligonucleotide
  source 1..20: mol_type = other DNA
tactgcatttccttttttaa

SEQ ID NO: 2318 - DNA, 20 bp, synthetic construct
  misc_feature 1..20: note = Synthetic oligonucleotide
  source 1..20: mol_type = other DNA
ataatacatttctttagata

SEQ ID NO: 2319 - DNA, 20 bp, synthetic construct
  misc_feature 1..20: note = Synthetic oligonucleotide
  source 1..20: mol_type = other DNA
gttatgcattatataattta

SEQ ID NO: 2320 - DNA, 20 bp, synthetic construct
  misc_feature 1..20: note = Synthetic oligonucleotide
  source 1..20: mol_type = other DNA
tttctctattctaattattt

SEQ ID NO: 2321 - DNA, 20 bp, synthetic construct
  misc_feature 1..20: note = Synthetic oligonucleotide
  source 1..20: mol_type = other DNA
accaggttttataaactcac

SEQ ID NO: 2322 - DNA, 20 bp, synthetic construct
  misc_feature 1..20: note = Synthetic oligonucleotide
  source 1..20: mol_type = other DNA
ataatctgatttaatcctca

SEQ ID NO: 2323 - DNA, 20 bp, synthetic construct
  misc_feature 1..20: note = Synthetic oligonucleotide
  source 1..20: mol_type = other DNA
ggtctcttagctttctcttc

SEQ ID NO: 2324 - DNA, 20 bp, synthetic construct
  misc_feature 1..20: note = Synthetic oligonucleotide
  source 1..20: mol_type = other DNA
aagtattttaataagtgatt

SEQ ID NO: 2325 - DNA, 20 bp, synthetic construct
  misc_feature 1..20: note = Synthetic oligonucleotide
  source 1..20: mol_type = other DNA
ttatcctcaatatattcatc

SEQ ID NO: 2326 - DNA, 20 bp, synthetic construct
  misc_feature 1..20: note = Synthetic oligonucleotide
  source 1..20: mol_type = other DNA
gaccgtctctttcttatttc

SEQ ID NO: 2327 - DNA, 20 bp, synthetic construct
  misc_feature 1..20: note = Synthetic oligonucleotide
  source 1..20: mol_type = other DNA
aaggtgtttcacctttaacc

SEQ ID NO: 2328 - DNA, 20 bp, synthetic construct
  misc_feature 1..20: note = Synthetic oligonucleotide
  source 1..20: mol_type = other DNA
gtatggttggaaatacagct

SEQ ID NO: 2329 - DNA, 20 bp, synthetic construct
  misc_feature 1..20: note = Synthetic oligonucleotide
  source 1..20: mol_type = other DNA
taacatggtcttaatggttt

SEQ ID NO: 2330 - DNA, 20 bp, synthetic construct
  misc_feature 1..20: note = Synthetic oligonucleotide
  source 1..20: mol_type = other DNA
tactttcacatttttccacc

SEQ ID NO: 2331 - DNA, 20 bp, synthetic construct
  misc_feature 1..20: note = Synthetic oligonucleotide
  source 1..20: mol_type = other DNA
atgggtgttccatcacattc

SEQ ID NO: 2332 - DNA, 20 bp, synthetic construct
  misc_feature 1..20: note = Synthetic oligonucleotide
  source 1..20: mol_type = other DNA
tggtgacaattactattatc

SEQ ID NO: 2333 - DNA, 20 bp, synthetic construct
  misc_feature 1..20: note = Synthetic oligonucleotide
  source 1..20: mol_type = other DNA
ggatatttttattttatgcc

SEQ ID NO: 2334 - DNA, 20 bp, synthetic construct
  misc_feature 1..20: note = Synthetic oligonucleotide
  source 1..20: mol_type = other DNA
tgggtaaaattactatttac

SEQ ID NO: 2335 - DNA, 20 bp, synthetic construct
  misc_feature 1..20: note = Synthetic oligonucleotide
  source 1..20: mol_type = other DNA
atggaaccaattacatcata

SEQ ID NO: 2336 - DNA, 20 bp, synthetic construct
  misc_feature 1..20: note = Synthetic oligonucleotide
  source 1..20: mol_type = other DNA
ccatatattttaaacagatt

SEQ ID NO: 2337 - DNA, 20 bp, synthetic construct
  misc_feature 1..20: note = Synthetic oligonucleotide
  source 1..20: mol_type = other DNA
cagaaacctacactgcatcc

SEQ ID NO: 2338 - DNA, 20 bp, synthetic construct
  misc_feature 1..20: note = Synthetic oligonucleotide
  source 1..20: mol_type = other DNA
aactggtaatataacttcac

SEQ ID NO: 2339 - DNA, 20 bp, synthetic construct
  misc_feature 1..20: note = Synthetic oligonucleotide
  source 1..20: mol_type = other DNA
aacctttattcttttggctt

SEQ ID NO: 2340 - DNA, 20 bp, synthetic construct
  misc_feature 1..20: note = Synthetic oligonucleotide
  source 1..20: mol_type = other DNA
aacttccattccatgaaaaa

SEQ ID NO: 2341 - DNA, 20 bp, synthetic construct
  misc_feature 1..20: note = Synthetic oligonucleotide
  source 1..20: mol_type = other DNA
gtcaattttttattaatttt

SEQ ID NO: 2342 - DNA, 20 bp, synthetic construct
  misc_feature 1..20: note = Synthetic oligonucleotide
  source 1..20: mol_type = other DNA
gggaaatccaccttatctct

SEQ ID NO: 2343 - DNA, 20 bp, synthetic construct
  misc_feature 1..20: note = Synthetic oligonucleotide
  source 1..20: mol_type = other DNA
gcaatttcttcctaagatca

SEQ ID NO: 2344 - DNA, 20 bp, synthetic construct
  misc_feature 1..20: note = Synthetic oligonucleotide
  source 1..20: mol_type = other DNA
gttgattactccttatggtc

SEQ ID NO: 2345 - DNA, 20 bp, synthetic construct
  misc_feature 1..20: note = Synthetic oligonucleotide
  source 1..20: mol_type = other DNA
cagtacttaaaaatatatta

SEQ ID NO: 2346 - DNA, 20 bp, synthetic construct
  misc_feature 1..20: note = Synthetic oligonucleotide
  source 1..20: mol_type = other DNA
ttttaataattgttaggata

SEQ ID NO: 2347 - DNA, 20 bp, synthetic construct
  misc_feature 1..20: note = Synthetic oligonucleotide
  source 1..20: mol_type = other DNA
tgggaattttatcatacact

SEQ ID NO: 2348 - DNA, 20 bp, synthetic construct
  misc_feature 1..20: note = Synthetic oligonucleotide
  source 1..20: mol_type = other DNA
gtctacttcctattttccat

SEQ ID NO: 2349 - DNA, 20 bp, synthetic construct
  misc_feature 1..20: note = Synthetic oligonucleotide
  source 1..20: mol_type = other DNA
ctttaatcaccatctaactt

SEQ ID NO: 2350 - DNA, 20 bp, synthetic construct
  misc_feature 1..20: note = Synthetic oligonucleotide
  source 1..20: mol_type = other DNA
ctttcagtatttacaatcca

SEQ ID NO: 2351 - DNA, 20 bp, synthetic construct
  misc_feature 1..20: note = Synthetic oligonucleotide
  source 1..20: mol_type = other DNA
atctattttatatataatta

SEQ ID NO: 2352 - DNA, 20 bp, synthetic construct
  misc_feature 1..20: note = Synthetic oligonucleotide
  source 1..20: mol_type = other DNA
gaacatttccaaaattgaac

SEQ ID NO: 2353 - DNA, 20 bp, synthetic construct
  misc_feature 1..20: note = Synthetic oligonucleotide
  source 1..20: mol_type = other DNA
tagaaataaatttatactaa

SEQ ID NO: 2354 - DNA, 20 bp, synthetic construct
  misc_feature 1..20: note = Synthetic oligonucleotide
  source 1..20: mol_type = other DNA
atttaagtcactaaaaagca

SEQ ID NO: 2355 - DNA, 20 bp, synthetic construct
  misc_feature 1..20: note = Synthetic oligonucleotide
  source 1..20: mol_type = other DNA
gagtttactcccttacctaa

SEQ ID NO: 2356 - DNA, 20 bp, synthetic construct
  misc_feature 1..20: note = Synthetic oligonucleotide
  source 1..20: mol_type = other DNA
aatctctgacttactagtca

SEQ ID NO: 2357 - DNA, 20 bp, synthetic construct
  misc_feature 1..20: note = Synthetic oligonucleotide
  source 1..20: mol_type = other DNA
actacagcatctatatacct

SEQ ID NO: 2358 - DNA, 20 bp, synthetic construct
  misc_feature 1..20: note = Synthetic oligonucleotide
  source 1..20: mol_type = other DNA
attttcctaccattttcaaa

SEQ ID NO: 2359 - DNA, 20 bp, synthetic construct
  misc_feature 1..20: note = Synthetic oligonucleotide
  source 1..20: mol_type = other DNA
atacagtcattatccactaa

SEQ ID NO: 2360 - DNA, 20 bp, synthetic construct
  misc_feature 1..20: note = Synthetic oligonucleotide
  source 1..20: mol_type = other DNA
taattattttctaattagtc

SEQ ID NO: 2361 - DNA, 20 bp, synthetic construct
  misc_feature 1..20: note = Synthetic oligonucleotide
  source 1..20: mol_type = other DNA
gcattatccccatttggata

SEQ ID NO: 2362 - DNA, 20 bp, synthetic construct
  misc_feature 1..20: note = Synthetic oligonucleotide
  source 1..20: mol_type = other DNA
tctgaattccacatacttga

SEQ ID NO: 2363 - DNA, 20 bp, synthetic construct
  misc_feature 1..20: note = Synthetic oligonucleotide
  source 1..20: mol_type = other DNA
aatgatcacattacttacac

SEQ ID NO: 2364 - DNA, 20 bp, synthetic construct
  misc_feature 1..20: note = Synthetic oligonucleotide
  source 1..20: mol_type = other DNA
ggcaaaaattcaacaagaca

SEQ ID NO: 2365 - DNA, 20 bp, synthetic construct
  misc_feature 1..20: note = Synthetic oligonucleotide
  source 1..20: mol_type = other DNA
gcattttccacattaattaa

SEQ ID NO: 2366 - DNA, 20 bp, synthetic construct
  misc_feature 1..20: note = Synthetic oligonucleotide
  source 1..20: mol_type = other DNA
aaatcatcttaaattagtct

SEQ ID NO: 2367 - DNA, 20 bp, synthetic construct
  misc_feature 1..20: note = Synthetic oligonucleotide
  source 1..20: mol_type = other DNA
attcttatttcatcttgata

SEQ ID NO: 2368 - DNA, 20 bp, synthetic construct
  misc_feature 1..20: note = Synthetic oligonucleotide
  source 1..20: mol_type = other DNA
gctttattctctattttaca

SEQ ID NO: 2369 - DNA, 20 bp, synthetic construct
  misc_feature 1..20: note = Synthetic oligonucleotide
  source 1..20: mol_type = other DNA
ggtattagctactaatgtcc

SEQ ID NO: 2370 - DNA, 20 bp, synthetic construct
  misc_feature 1..20: note = Synthetic oligonucleotide
  source 1..20: mol_type = other DNA
actttgacctttattacata

SEQ ID NO: 2371 - DNA, 20 bp, synthetic construct
  misc_feature 1..20: note = Synthetic oligonucleotide
  source 1..20: mol_type = other DNA
tctatattataaaaaggtaa

SEQ ID NO: 2372 - DNA, 20 bp, synthetic construct
  misc_feature 1..20: note = Synthetic oligonucleotide
  source 1..20: mol_type = other DNA
ttatgtgattctattcatta

SEQ ID NO: 2373 - DNA, 20 bp, synthetic construct
  misc_feature 1..20: note = Synthetic oligonucleotide
  source 1..20: mol_type = other DNA
ttaatataatccaaatggct

SEQ ID NO: 2374 - DNA, 20 bp, synthetic construct
  misc_feature 1..20: note = Synthetic oligonucleotide
  source 1..20: mol_type = other DNA
gaaggcttatttaatccatt

SEQ ID NO: 2375 - DNA, 20 bp, synthetic construct
  misc_feature 1..20: note = Synthetic oligonucleotide
  source 1..20: mol_type = other DNA
tgccagctgtcatttagcaa

SEQ ID NO: 2376 - DNA, 20 bp, synthetic construct
  misc_feature 1..20: note = Synthetic oligonucleotide
  source 1..20: mol_type = other DNA
agtcagtcactttaatacta

SEQ ID NO: 2377 - DNA, 20 bp, synthetic construct
  misc_feature 1..20: note = Synthetic oligonucleotide
  source 1..20: mol_type = other DNA
aagttccatctctctacatt

SEQ ID NO: 2378 - DNA, 20 bp, synthetic construct
  misc_feature 1..20: note = Synthetic oligonucleotide
  source 1..20: mol_type = other DNA
aagaaattcttacatagctc

SEQ ID NO: 2379 - DNA, 20 bp, synthetic construct
  misc_feature 1..20: note = Synthetic oligonucleotide
  source 1..20: mol_type = other DNA
gtctattacttcttgagtca

SEQ ID NO: 2380 - DNA, 20 bp, synthetic construct
  misc_feature 1..20: note = Synthetic oligonucleotide
  source 1..20: mol_type = other DNA
ttataataatcctttacata

SEQ ID NO: 2381 - DNA, 20 bp, synthetic construct
  misc_feature 1..20: note = Synthetic oligonucleotide
  source 1..20: mol_type = other DNA
gctctgttccattctttcta

SEQ ID NO: 2382 - DNA, 20 bp, synthetic construct
  misc_feature 1..20: note = Synthetic oligonucleotide
  source 1..20: mol_type = other DNA
gcctattcaatacctacatt

SEQ ID NO: 2383 - DNA, 20 bp, synthetic construct
  misc_feature 1..20: note = Synthetic oligonucleotide
  source 1..20: mol_type = other DNA
atactttctttaaaattaac

SEQ ID NO: 2384 - DNA, 20 bp, synthetic construct
  misc_feature 1..20: note = Synthetic oligonucleotide
  source 1..20: mol_type = other DNA
agaggattttctccttgcct

SEQ ID NO: 2385 - DNA, 20 bp, synthetic construct
  misc_feature 1..20: note = Synthetic oligonucleotide
  source 1..20: mol_type = other DNA
cagatcataataacaataaa

SEQ ID NO: 2386 - DNA, 20 bp, synthetic construct
  misc_feature 1..20: note = Synthetic oligonucleotide
  source 1..20: mol_type = other DNA
atctttgtttttccttgtta

SEQ ID NO: 2387 - DNA, 20 bp, synthetic construct
  misc_feature 1..20: note = Synthetic oligonucleotide
  source 1..20: mol_type = other DNA
gccattttccctaaaatgaa

SEQ ID NO: 2388 - DNA, 20 bp, synthetic construct
  misc_feature 1..20: note = Synthetic oligonucleotide
  source 1..20: mol_type = other DNA
tttaaggtcataattacgat

SEQ ID NO: 2389 - DNA, 20 bp, synthetic construct
  misc_feature 1..20: note = Synthetic oligonucleotide
  source 1..20: mol_type = other DNA
atatggataatacaccaata

SEQ ID NO: 2390 - DNA, 20 bp, synthetic construct
  misc_feature 1..20: note = Synthetic oligonucleotide
  source 1..20: mol_type = other DNA
ctataattttctaattccaa

SEQ ID NO: 2391 - DNA, 20 bp, synthetic construct
  misc_feature 1..20: note = Synthetic oligonucleotide
  source 1..20: mol_type = other DNA
aatagcgaatcagtgtgaag

SEQ ID NO: 2392 - DNA, 20 bp, synthetic construct
  misc_feature 1..20: note = Synthetic oligonucleotide
  source 1..20: mol_type = other DNA
tatatgtatttaaattggta

SEQ ID NO: 2393 - DNA, 20 bp, synthetic construct
  misc_feature 1..20: note = Synthetic oligonucleotide
  source 1..20: mol_type = other DNA
aatcttgattcaaatcagca

SEQ ID NO: 2394 - DNA, 20 bp, synthetic construct
  misc_feature 1..20: note = Synthetic oligonucleotide
  source 1..20: mol_type = other DNA
acaatatattctactgcatt

SEQ ID NO: 2395 - DNA, 20 bp, synthetic construct
  misc_feature 1..20: note = Synthetic oligonucleotide
  source 1..20: mol_type = other DNA
ttaactatattaacatataa

SEQ ID NO: 2396 - DNA, 20 bp, synthetic construct
  misc_feature 1..20: note = Synthetic oligonucleotide
  source 1..20: mol_type = other DNA
gaacatttaatattttcaca

SEQ ID NO: 2397 - DNA, 20 bp, synthetic construct
  misc_feature 1..20: note = Synthetic oligonucleotide
  source 1..20: mol_type = other DNA
ttttttctctattctaatta

SEQ ID NO: 2398 - DNA, 20 bp, synthetic construct
  misc_feature 1..20: note = Synthetic oligonucleotide
  source 1..20: mol_type = other DNA
acaatgttctattctattaa

SEQ ID NO: 2399 - DNA, 20 bp, synthetic construct
  misc_feature 1..20: note = Synthetic oligonucleotide
  source 1..20: mol_type = other DNA
tttatatgtccaaaatacta

SEQ ID NO: 2400 - DNA, 20 bp, synthetic construct
  misc_feature 1..20: note = Synthetic oligonucleotide
  source 1..20: mol_type = other DNA
tgggtctcttagctttctct

SEQ ID NO: 2401 - DNA, 20 bp, synthetic construct
  misc_feature 1..20: note = Synthetic oligonucleotide
  source 1..20: mol_type = other DNA
gcaagtattttaataagtga

SEQ ID NO: 2402 - DNA, 20 bp, synthetic construct
  misc_feature 1..20: note = Synthetic oligonucleotide
  source 1..20: mol_type = other DNA
tttatcctcaatatattcat

SEQ ID NO: 2403 - DNA, 20 bp, synthetic construct
  misc_feature 1..20: note = Synthetic oligonucleotide
  source 1..20: mol_type = other DNA
actggaccgtctctttctta

SEQ ID NO: 2404 - DNA, 20 bp, synthetic construct
  misc_feature 1..20: note = Synthetic oligonucleotide
  source 1..20: mol_type = other DNA
caaggtgtttcacctttaac

SEQ ID NO: 2405 - DNA, 20 bp, synthetic construct
  misc_feature 1..20: note = Synthetic oligonucleotide
  source 1..20: mol_type = other DNA
tggtatggttggaaatacag

SEQ ID NO: 2406 - DNA, 20 bp, synthetic construct
  misc_feature 1..20: note = Synthetic oligonucleotide
  source 1..20: mol_type = other DNA
agcatattctaacatggtct

SEQ ID NO: 2407 - DNA, 20 bp, synthetic construct
  misc_feature 1..20: note = Synthetic oligonucleotide
  source 1..20: mol_type = other DNA
agagacagatatccaagtcc

SEQ ID NO: 2408 - DNA, 20 bp, synthetic construct
  misc_feature 1..20: note = Synthetic oligonucleotide
  source 1..20: mol_type = other DNA
gttgaattctcattcagttt

SEQ ID NO: 2409 - DNA, 20 bp, synthetic construct
  misc_feature 1..20: note = Synthetic oligonucleotide
  source 1..20: mol_type = other DNA
aaatatatccagttatacaa

SEQ ID NO: 2410 - DNA, 20 bp, synthetic construct
  misc_feature 1..20: note = Synthetic oligonucleotide
  source 1..20: mol_type = other DNA
aggatatttttattttatgc

SEQ ID NO: 2411 - DNA, 20 bp, synthetic construct
  misc_feature 1..20: note = Synthetic oligonucleotide
  source 1..20: mol_type = other DNA
ctgggtaaaattactattta

SEQ ID NO: 2412 - DNA, 20 bp, synthetic construct
  misc_feature 1..20: note = Synthetic oligonucleotide
  source 1..20: mol_type = other DNA
taatggaaccaattacatca

SEQ ID NO: 2413 - DNA, 20 bp, synthetic construct
  misc_feature 1..20: note = Synthetic oligonucleotide
  source 1..20: mol_type = other DNA
accatatattttaaacagat

SEQ ID NO: 2414 - DNA, 20 bp, synthetic construct
  misc_feature 1..20: note = Synthetic oligonucleotide
  source 1..20: mol_type = other DNA
agcagaaacctacactgcat

SEQ ID NO: 2415 - DNA, 20 bp, synthetic construct
  misc_feature 1..20: note = Synthetic oligonucleotide
  source 1..20: mol_type = other DNA
taactggtaatataacttca

SEQ ID NO: 2416 - DNA, 20 bp, synthetic construct
  misc_feature 1..20: note = Synthetic oligonucleotide
  source 1..20: mol_type = other DNA
aaacctttattcttttggct

SEQ ID NO: 2417 - DNA, 20 bp, synthetic construct
  misc_feature 1..20: note = Synthetic oligonucleotide
  source 1..20: mol_type = other DNA
ttaacttccattccatgaaa

SEQ ID NO: 2418 - DNA, 20 bp, synthetic construct
  misc_feature 1..20: note = Synthetic oligonucleotide
  source 1..20: mol_type = other DNA
tagtcaattttttattaatt

SEQ ID NO: 2419 - DNA, 20 bp, synthetic construct
  misc_feature 1..20: note = Synthetic oligonucleotide
  source 1..20: mol_type = other DNA
acaatcttttctattaggta

SEQ ID NO: 2420 - DNA, 20 bp, synthetic construct
  misc_feature 1..20: note = Synthetic oligonucleotide
  source 1..20: mol_type = other DNA
aaactataaaaataatctaa

SEQ ID NO: 2421 - DNA, 20 bp, synthetic construct
  misc_feature 1..20: note = Synthetic oligonucleotide
  source 1..20: mol_type = other DNA
attatattaaatcatatttt

SEQ ID NO: 2422 - DNA, 20 bp, synthetic construct
  misc_feature 1..20: note = Synthetic oligonucleotide
  source 1..20: mol_type = other DNA
aataagatccaaaatagtaa

SEQ ID NO: 2423 - DNA, 20 bp, synthetic construct
  misc_feature 1..20: note = Synthetic oligonucleotide
  source 1..20: mol_type = other DNA
attttaataattgttaggat

SEQ ID NO: 2424 - DNA, 20 bp, synthetic construct
  misc_feature 1..20: note = Synthetic oligonucleotide
  source 1..20: mol_type = other DNA
attatcttttttatatgccc

SEQ ID NO: 2425 - DNA, 20 bp, synthetic construct
  misc_feature 1..20: note = Synthetic oligonucleotide
  source 1..20: mol_type = other DNA
tagaaatattctacatctta

SEQ ID NO: 2426 - DNA, 20 bp, synthetic construct
  misc_feature 1..20: note = Synthetic oligonucleotide
  source 1..20: mol_type = other DNA
attcaactctttaatcacca

SEQ ID NO: 2427 - DNA, 20 bp, synthetic construct
  misc_feature 1..20: note = Synthetic oligonucleotide
  source 1..20: mol_type = other DNA
tcttactctcctactttcta

SEQ ID NO: 2428 - DNA, 20 bp, synthetic construct
  misc_feature 1..20: note = Synthetic oligonucleotide
  source 1..20: mol_type = other DNA
tccatctattttatatataa

SEQ ID NO: 2429 - DNA, 20 bp, synthetic construct
  misc_feature 1..20: note = Synthetic oligonucleotide
  source 1..20: mol_type = other DNA
catctctcctcatattcatt

SEQ ID NO: 2430 - DNA, 20 bp, synthetic construct
  misc_feature 1..20: note = Synthetic oligonucleotide
  source 1..20: mol_type = other DNA
atactcttttcctttagttt

SEQ ID NO: 2431 - DNA, 20 bp, synthetic construct
  misc_feature 1..20: note = Synthetic oligonucleotide
  source 1..20: mol_type = other DNA
acaccaatcttatttatctc

SEQ ID NO: 2432 - DNA, 20 bp, synthetic construct
  misc_feature 1..20: note = Synthetic oligonucleotide
  source 1..20: mol_type = other DNA
tatttattttccaaatgtaa

SEQ ID NO: 2433 - DNA, 20 bp, synthetic construct
  misc_feature 1..20: note = Synthetic oligonucleotide
  source 1..20: mol_type = other DNA
ctgattctctaatctctgac

SEQ ID NO: 2434 - DNA, 20 bp, synthetic construct
  misc_feature 1..20: note = Synthetic oligonucleotide
  source 1..20: mol_type = other DNA
aactacagcatctatatacc

SEQ ID NO: 2435 - DNA, 20 bp, synthetic construct
  misc_feature 1..20: note = Synthetic oligonucleotide
  source 1..20: mol_type = other DNA
cattttcctaccattttcaa

SEQ ID NO: 2436 - DNA, 20 bp, synthetic construct
  misc_feature 1..20: note = Synthetic oligonucleotide
  source 1..20: mol_type = other DNA
gatacatcccttaccagcca

SEQ ID NO: 2437 - DNA, 20 bp, synthetic construct
  misc_feature 1..20: note = Synthetic oligonucleotide
  source 1..20: mol_type = other DNA
gagaaataattattttctaa

SEQ ID NO: 2438 - DNA, 20 bp, synthetic construct
  misc_feature 1..20: note = Synthetic oligonucleotide
  source 1..20: mol_type = other DNA
tgcattatccccatttggat

SEQ ID NO: 2439 - DNA, 20 bp, synthetic construct
  misc_feature 1..20: note = Synthetic oligonucleotide
  source 1..20: mol_type = other DNA
taaccattatatacccacca

SEQ ID NO: 2440 - DNA, 20 bp, synthetic construct
  misc_feature 1..20: note = Synthetic oligonucleotide
  source 1..20: mol_type = other DNA
ataaatgatcacattactta

SEQ ID NO: 2441 - DNA, 20 bp, synthetic construct
  misc_feature 1..20: note = Synthetic oligonucleotide
  source 1..20: mol_type = other DNA
acatatgtaaaccctggcaa

SEQ ID NO: 2442 - DNA, 20 bp, synthetic construct
  misc_feature 1..20: note = Synthetic oligonucleotide
  source 1..20: mol_type = other DNA
tgcattttccacattaatta

SEQ ID NO: 2443 - DNA, 20 bp, synthetic construct
  misc_feature 1..20: note = Synthetic oligonucleotide
  source 1..20: mol_type = other DNA
taaatcatcttaaattagtc

SEQ ID NO: 2444 - DNA, 20 bp, synthetic construct
  misc_feature 1..20: note = Synthetic oligonucleotide
  source 1..20: mol_type = other DNA
tttatattcacatacaaaca

SEQ ID NO: 2445 - DNA, 20 bp, synthetic construct
  misc_feature 1..20: note = Synthetic oligonucleotide
  source 1..20: mol_type = other DNA
cttaagaattctattaagct

SEQ ID NO: 2446 - DNA, 20 bp, synthetic construct
  misc_feature 1..20: note = Synthetic oligonucleotide
  source 1..20: mol_type = other DNA
atcaattgatttacttatca

SEQ ID NO: 2447 - DNA, 20 bp, synthetic construct
  misc_feature 1..20: note = Synthetic oligonucleotide
  source 1..20: mol_type = other DNA
gtctgaattattaaatgtaa

SEQ ID NO: 2448 - DNA, 20 bp, synthetic construct
  misc_feature 1..20: note = Synthetic oligonucleotide
  source 1..20: mol_type = other DNA
gtctatattataaaaaggta

SEQ ID NO: 2449 - DNA, 20 bp, synthetic construct
  misc_feature 1..20: note = Synthetic oligonucleotide
  source 1..20: mol_type = other DNA
agctaaagaattactttttc

SEQ ID NO: 2450 - DNA, 20 bp, synthetic construct
  misc_feature 1..20: note = Synthetic oligonucleotide
  source 1..20: mol_type = other DNA
agcagttaatataatccaaa

SEQ ID NO: 2451 - DNA, 20 bp, synthetic construct
  misc_feature 1..20: note = Synthetic oligonucleotide
  source 1..20: mol_type = other DNA
ataatatttattaactgtct

SEQ ID NO: 2452 - DNA, 20 bp, synthetic construct
  misc_feature 1..20: note = Synthetic oligonucleotide
  source 1..20: mol_type = other DNA
ttacagtaaataacaaaaaa

SEQ ID NO: 2453 - DNA, 20 bp, synthetic construct
  misc_feature 1..20: note = Synthetic oligonucleotide
  source 1..20: mol_type = other DNA
ttctttttaaatccatggca

SEQ ID NO: 2454 - DNA, 20 bp, synthetic construct
  misc_feature 1..20: note = Synthetic oligonucleotide
  source 1..20: mol_type = other DNA
acaaagttccatctctctac

SEQ ID NO: 2455 - DNA, 20 bp, synthetic construct
  misc_feature 1..20: note = Synthetic oligonucleotide
  source 1..20: mol_type = other DNA
ctttcttgtttcaattgcca

SEQ ID NO: 2456 - DNA, 20 bp, synthetic construct
  misc_feature 1..20: note = Synthetic oligonucleotide
  source 1..20: mol_type = other DNA
ctggcattaatatcagggta

SEQ ID NO: 2457 - DNA, 20 bp, synthetic construct
  misc_feature 1..20: note = Synthetic oligonucleotide
  source 1..20: mol_type = other DNA
tatgtctattcaaatatttt

SEQ ID NO: 2458 - DNA, 20 bp, synthetic construct
  misc_feature 1..20: note = Synthetic oligonucleotide
  source 1..20: mol_type = other DNA
gtttcttcaaatatttgctc

SEQ ID NO: 2459 - DNA, 20 bp, synthetic construct
  misc_feature 1..20: note = Synthetic oligonucleotide
  source 1..20: mol_type = other DNA
acctgcctattcaataccta

SEQ ID NO: 2460 - DNA, 20 bp, synthetic construct
  misc_feature 1..20: note = Synthetic oligonucleotide
  source 1..20: mol_type = other DNA
aggtaaatcatctataggaa

SEQ ID NO: 2461 - DNA, 20 bp, synthetic construct
  misc_feature 1..20: note = Synthetic oligonucleotide
  source 1..20: mol_type = other DNA
atcaaatctataacataatt

SEQ ID NO: 2462 - DNA, 20 bp, synthetic construct
  misc_feature 1..20: note = Synthetic oligonucleotide
  source 1..20: mol_type = other DNA
ctgtgacatttatatagcct

SEQ ID NO: 2463 - DNA, 20 bp, synthetic construct
  misc_feature 1..20: note = Synthetic oligonucleotide
  source 1..20: mol_type = other DNA
ttagtaattttatcaaataa

SEQ ID NO: 2464 - DNA, 20 bp, synthetic construct
  misc_feature 1..20: note = Synthetic oligonucleotide
  source 1..20: mol_type = other DNA
ggtcaactcctaaataaagc

SEQ ID NO: 2465 - DNA, 20 bp, synthetic construct
  misc_feature 1..20: note = Synthetic oligonucleotide
  source 1..20: mol_type = other DNA
ttaaaattacattctaggca

SEQ ID NO: 2466 - DNA, 20 bp, synthetic construct
  misc_feature 1..20: note = Synthetic oligonucleotide
  source 1..20: mol_type = other DNA
catatggataatacaccaat

SEQ ID NO: 2467 - DNA, 20 bp, synthetic construct
  misc_feature 1..20: note = Synthetic oligonucleotide
  source 1..20: mol_type = other DNA
atatattctataattttcta

SEQ ID NO: 2468 - DNA, 20 bp, synthetic construct
  misc_feature 1..20: note = Synthetic oligonucleotide
  source 1..20: mol_type = other DNA
gcaatagcgaatcagtgtga

SEQ ID NO: 2469 - DNA, 20 bp, synthetic construct
  misc_feature 1..20: note = Synthetic oligonucleotide
  source 1..20: mol_type = other DNA
atttgatttttatctatgaa

SEQ ID NO: 2470 - DNA, 20 bp, synthetic construct
  misc_feature 1..20: note = Synthetic oligonucleotide
  source 1..20: mol_type = other DNA
ctttttagccatttcagcct

SEQ ID NO: 2471 - DNA, 20 bp, synthetic construct
  misc_feature 1..20: note = Synthetic oligonucleotide
  source 1..20: mol_type = other DNA
ttattcttttctaaatgatt

SEQ ID NO: 2472 - DNA, 20 bp, synthetic construct
  misc_feature 1..20: note = Synthetic oligonucleotide
  source 1..20: mol_type = other DNA
gtcaaaacttttaagattta

SEQ ID NO: 2473 - DNA, 20 bp, synthetic construct
  misc_feature 1..20: note = Synthetic oligonucleotide
  source 1..20: mol_type = other DNA
gcctgtttcattaatgattc

SEQ ID NO: 2474 - DNA, 20 bp, synthetic construct
  misc_feature 1..20: note = Synthetic oligonucleotide
  source 1..20: mol_type = other DNA
tgatagctcacaaatccatc

SEQ ID NO: 2475 - DNA, 20 bp, synthetic construct
  misc_feature 1..20: note = Synthetic oligonucleotide
  source 1..20: mol_type = other DNA
cttaatgctacctcatagca

SEQ ID NO: 2476 - DNA, 20 bp, synthetic construct
  misc_feature 1..20: note = Synthetic oligonucleotide
  source 1..20: mol_type = other DNA
agtacagaaattaatttata

SEQ ID NO: 2477 - DNA, 20 bp, synthetic construct
  misc_feature 1..20: note = Synthetic oligonucleotide
  source 1..20: mol_type = other DNA
gaccgaattctattttataa

SEQ ID NO: 2478 - DNA, 20 bp, synthetic construct
  misc_feature 1..20: note = Synthetic oligonucleotide
  source 1..20: mol_type = other DNA
accgaattctattttataaa

SEQ ID NO: 2479 - DNA, 20 bp, synthetic construct
  misc_feature 1..20: note = Synthetic oligonucleotide
  source 1..20: mol_type = other DNA
ccgaattctattttataaat

SEQ ID NO: 2480 - DNA, 20 bp, synthetic construct
  misc_feature 1..20: note = Synthetic oligonucleotide
  source 1..20: mol_type = other DNA
cgaattctattttataaatg

SEQ ID NO: 2481 - DNA, 20 bp, synthetic construct
  misc_feature 1..20: note = Synthetic oligonucleotide
  source 1..20: mol_type = other DNA
gaattctattttataaatgc

SEQ ID NO: 2482 - DNA, 20 bp, synthetic construct
  misc_feature 1..20: note = Synthetic oligonucleotide
  source 1..20: mol_type = other DNA
aattctattttataaatgcc

SEQ ID NO: 2483 - DNA, 20 bp, synthetic construct
  misc_feature 1..20: note = Synthetic oligonucleotide
  source 1..20: mol_type = other DNA
atgtaacctttatacattta

SEQ ID NO: 2484 - DNA, 20 bp, synthetic construct
  misc_feature 1..20: note = Synthetic oligonucleotide
  source 1..20: mol_type = other DNA
attctgcatgtaacctttat

SEQ ID NO: 2485 - DNA, 20 bp, synthetic construct
  misc_feature 1..20: note = Synthetic oligonucleotide
  source 1..20: mol_type = other DNA
ttctgcatgtaacctttata

SEQ ID NO: 2486 - DNA, 20 bp, synthetic construct
  misc_feature 1..20: note = Synthetic oligonucleotide
  source 1..20: mol_type = other DNA
tgcatgtaacctttatacat

SEQ ID NO: 2487 - DNA, 20 bp, synthetic construct
  misc_feature 1..20: note = Synthetic oligonucleotide
  source 1..20: mol_type = other DNA
tctgcatgtaacctttatac

SEQ ID NO: 2488 - DNA, 20 bp, synthetic construct
  misc_feature 1..20: note = Synthetic oligonucleotide
  source 1..20: mol_type = other DNA
catgtaacctttatacattt

SEQ ID NO: 2489 - DNA, 20 bp, synthetic construct
  misc_feature 1..20: note = Synthetic oligonucleotide
  source 1..20: mol_type = other DNA
gcatgtaacctttatacatt

SEQ ID NO: 2490 - DNA, 20 bp, synthetic construct
  misc_feature 1..20: note = Synthetic oligonucleotide
  source 1..20: mol_type = other DNA
tgtaacctttatacatttaa

SEQ ID NO: 2491 - DNA, 20 bp, synthetic construct
  misc_feature 1..20: note = Synthetic oligonucleotide
  source 1..20: mol_type = other DNA
gtaacctttatacatttaat

SEQ ID NO: 2492 - DNA, 20 bp, synthetic construct
  misc_feature 1..20: note = Synthetic oligonucleotide
  source 1..20: mol_type = other DNA
ccagttttttcattgcatcc

SEQ ID NO: 2493 - DNA, 20 bp, synthetic construct
  misc_feature 1..20: note = Synthetic oligonucleotide
  source 1..20: mol_type = other DNA
gcataatcccattatacaaa

SEQ ID NO: 2494 - DNA, 20 bp, synthetic construct
  misc_feature 1..20: note = Synthetic oligonucleotide
  source 1..20: mol_type = other DNA
atcatgcataatcccattat

SEQ ID NO: 2495 - DNA, 20 bp, synthetic construct
  misc_feature 1..20: note = Synthetic oligonucleotide
  source 1..20: mol_type = other DNA
tcatgcataatcccattata

SEQ ID NO: 2496 - DNA, 20 bp, synthetic construct
  misc_feature 1..20: note = Synthetic oligonucleotide
  source 1..20: mol_type = other DNA
cataatcccattatacaaat

SEQ ID NO: 2497 - DNA, 20 bp, synthetic construct
  misc_feature 1..20: note = Synthetic oligonucleotide
  source 1..20: mol_type = other DNA
tgcataatcccattatacaa

SEQ ID NO: 2498 - DNA, 20 bp, synthetic construct
  misc_feature 1..20: note = Synthetic oligonucleotide
  source 1..20: mol_type = other DNA
catgcataatcccattatac

SEQ ID NO: 2499 - DNA, 20 bp, synthetic construct
  misc_feature 1..20: note = Synthetic oligonucleotide
  source 1..20: mol_type = other DNA
tctttcttatttctgtttca

SEQ ID NO: 2500 - DNA, 20 bp, synthetic construct
  misc_feature 1..20: note = Synthetic oligonucleotide
  source 1..20: mol_type = other DNA
ctctttcttatttctgtttc

SEQ ID NO: 2501 - DNA, 20 bp, synthetic construct
  misc_feature 1..20: note = Synthetic oligonucleotide
  source 1..20: mol_type = other DNA
tggaccgtctctttcttatt

SEQ ID NO: 2502 - DNA, 20 bp, synthetic construct
  misc_feature 1..20: note = Synthetic oligonucleotide
  source 1..20: mol_type = other DNA
ctggaccgtctctttcttat

SEQ ID NO: 2503 - DNA, 20 bp, synthetic construct
  misc_feature 1..20: note = Synthetic oligonucleotide
  source 1..20: mol_type = other DNA
cacgcttacatcaaacatct

SEQ ID NO: 2504 - DNA, 20 bp, synthetic construct
  misc_feature 1..20: note = Synthetic oligonucleotide
  source 1..20: mol_type = other DNA
tatttttctacactgctgcc

SEQ ID NO: 2505 - DNA, 20 bp, synthetic construct
  misc_feature 1..20: note = Synthetic oligonucleotide
  source 1..20: mol_type = other DNA
atatttttctacactgctgc

SEQ ID NO: 2506 - DNA, 20 bp, synthetic construct
  misc_feature 1..20: note = Synthetic oligonucleotide
  source 1..20: mol_type = other DNA
catatttttctacactgctg

SEQ ID NO: 2507 - DNA, 20 bp, synthetic construct
  misc_feature 1..20: note = Synthetic oligonucleotide
  source 1..20: mol_type = other DNA
atgtaatcactttcatccac

SEQ ID NO: 2508 - DNA, 20 bp, synthetic construct
  misc_feature 1..20: note = Synthetic oligonucleotide
  source 1..20: mol_type = other DNA
aatcactttcatccacgaca

SEQ ID NO: 2509 - DNA, 20 bp, synthetic construct
  misc_feature 1..20: note = Synthetic oligonucleotide
  source 1..20: mol_type = other DNA
taatcactttcatccacgac

SEQ ID NO: 2510 - DNA, 20 bp, synthetic construct
  misc_feature 1..20: note = Synthetic oligonucleotide
  source 1..20: mol_type = other DNA
ccacgacatatttttctaca

SEQ ID NO: 2511 - DNA, 20 bp, synthetic construct
  misc_feature 1..20: note = Synthetic oligonucleotide
  source 1..20: mol_type = other DNA
atcactttcatccacgacat

SEQ ID NO: 2512 - DNA, 20 bp, synthetic construct
  misc_feature 1..20: note = Synthetic oligonucleotide
  source 1..20: mol_type = other DNA
acgacatatttttctacact

SEQ ID NO: 2513 - DNA, 20 bp, synthetic construct
  misc_feature 1..20: note = Synthetic oligonucleotide
  source 1..20: mol_type = other DNA
tccacgacatatttttctac

SEQ ID NO: 2514 - DNA, 20 bp, synthetic construct
  misc_feature 1..20: note = Synthetic oligonucleotide
  source 1..20: mol_type = other DNA
cacgacatatttttctacac

SEQ ID NO: 2515 - DNA, 20 bp, synthetic construct
  misc_feature 1..20: note = Synthetic oligonucleotide
  source 1..20: mol_type = other DNA
gcatgtttatcttagttcta

SEQ ID NO: 2516 - DNA, 20 bp, synthetic construct
  misc_feature 1..20: note = Synthetic oligonucleotide
  source 1..20: mol_type = other DNA
ccatttctataactcagcaa

SEQ ID NO: 2517 - DNA, 20 bp, synthetic construct
  misc_feature 1..20: note = Synthetic oligonucleotide
  source 1..20: mol_type = other DNA
ttgaccacgcttacatcaaa

SEQ ID NO: 2518 - DNA, 20 bp, synthetic construct
  misc_feature 1..20: note = Synthetic oligonucleotide
  source 1..20: mol_type = other DNA
agcatgtttatcttagttct

SEQ ID NO: 2519 - DNA, 20 bp, synthetic construct
  misc_feature 1..20: note = Synthetic oligonucleotide
  source 1..20: mol_type = other DNA
catttctataactcagcaac

SEQ ID NO: 2520 - DNA, 20 bp, synthetic construct
  misc_feature 1..20: note = Synthetic oligonucleotide
  source 1..20: mol_type = other DNA
atttctataactcagcaacc

SEQ ID NO: 2521 - DNA, 20 bp, synthetic construct
  misc_feature 1..20: note = Synthetic oligonucleotide
  source 1..20: mol_type = other DNA
catgtaatcactttcatcca

SEQ ID NO: 2522 - DNA, 20 bp, synthetic construct
  misc_feature 1..20: note = Synthetic oligonucleotide
  source 1..20: mol_type = other DNA
tgaccacgcttacatcaaac

SEQ ID NO: 2523 - DNA, 20 bp, synthetic construct
  misc_feature 1..20: note = Synthetic oligonucleotide
  source 1..20: mol_type = other DNA
tcagcatgtttatcttagtt

SEQ ID NO: 2524 - DNA, 20 bp, synthetic construct
  misc_feature 1..20: note = Synthetic oligonucleotide
  source 1..20: mol_type = other DNA
tgccatttctataactcagc

SEQ ID NO: 2525 - DNA, 20 bp, synthetic construct
  misc_feature 1..20: note = Synthetic oligonucleotide
  source 1..20: mol_type = other DNA
tttgggccattttcatcatc

SEQ ID NO: 2526 - DNA, 20 bp, synthetic construct
  misc_feature 1..20: note = Synthetic oligonucleotide
  source 1..20: mol_type = other DNA
ggaccgtctctttcttattt

SEQ ID NO: 2527 - DNA, 20 bp, synthetic construct
  misc_feature 1..20: note = Synthetic oligonucleotide
  source 1..20: mol_type = other DNA
gcatattctaacatggtctt

SEQ ID NO: 2528 - DNA, 20 bp, synthetic construct
  misc_feature 1..20: note = Synthetic oligonucleotide
  source 1..20: mol_type = other DNA
tattttataaatgccgactt

SEQ ID NO: 2529 - DNA, 20 bp, synthetic construct
  misc_feature 1..20: note = Synthetic oligonucleotide
  source 1..20: mol_type = other DNA
gttttttcattgcatcctcc

SEQ ID NO: 2530 - DNA, 20 bp, synthetic construct
  misc_feature 1..20: note = Synthetic oligonucleotide
  source 1..20: mol_type = other DNA
agttttttcattgcatcctc

SEQ ID NO: 2531 - DNA, 20 bp, synthetic construct
  misc_feature 1..20: note = Synthetic oligonucleotide
  source 1..20: mol_type = other DNA
cagttttttcattgcatcct

SEQ ID NO: 2532 - DNA, 18 bp, synthetic construct
  misc_feature 1..18: note = Synthetic oligonucleotide
  source 1..18: mol_type = other DNA
ctattttataaatgccga

SEQ ID NO: 2533 - DNA, 18 bp, synthetic construct
  misc_feature 1..18: note = Synthetic oligonucleotide
  source 1..18: mol_type = other DNA
tctgcatgtaacctttat

SEQ ID NO: 2534 - DNA, 18 bp, synthetic construct
  misc_feature 1..18: note = Synthetic oligonucleotide
  source 1..18: mol_type = other DNA
ctgcatgtaacctttata

SEQ ID NO: 2535 - DNA, 18 bp, synthetic construct
  misc_feature 1..18: note = Synthetic oligonucleotide
  source 1..18: mol_type = other DNA
tgcatgtaacctttatac

SEQ ID NO: 2536 - DNA, 18 bp, synthetic construct
  misc_feature 1..18: note = Synthetic oligonucleotide
  source 1..18: mol_type = other DNA
tctattttataaatgccg

SEQ ID NO: 2537 - DNA, 18 bp, synthetic construct
  misc_feature 1..18: note = Synthetic oligonucleotide
  source 1..18: mol_type = other DNA
gcatgtaacctttataca

SEQ ID NO: 2538 - DNA, 18 bp, synthetic construct
  misc_feature 1..18: note = Synthetic oligonucleotide
  source 1..18: mol_type = other DNA
catgtaacctttatacat

SEQ ID NO: 2539 - DNA, 18 bp, synthetic construct
  misc_feature 1..18: note = Synthetic oligonucleotide
  source 1..18: mol_type = other DNA
acccagttttttcattgc

SEQ ID NO: 2540 - DNA, 16 bp, synthetic construct
  misc_feature 1..16: note = Synthetic oligonucleotide
  source 1..16: mol_type = other DNA
tgggtctcttagcttt

The invention claimed is:

1. An oligomeric compound comprising a 6-10-4 MOE gapmer having a sequence (from 5' to 3') of CCACGACAT-ATTTTTCTACA (SEQ ID NO: 2510);
   wherein each of nucleosides 1-6 and 17-20 (from 5' to 3') are 2'-MOE nucleosides and each of nucleosides 7-16 are 2'-β-D-deoxynucleosides;
   wherein the internucleoside linkages between nucleosides 2 to 3, 3 to 4, 4 to 5, 5 to 6, 6 to 7, and 17 to 18 are phosphodiester internucleoside linkages, the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages; and
   wherein each cytosine is a 5-methyl cytosine.

2. A pharmaceutical composition comprising the oligomeric compound of claim 1 and a pharmaceutically acceptable diluent or carrier.

3. The pharmaceutical composition of claim 2, wherein the pharmaceutically acceptable diluent is artificial CSF (aCSF) or phosphate-buffered saline (PBS).

4. The pharmaceutical composition of claim 3, wherein the pharmaceutical composition consists essentially of the oligomeric compound and aCSF; or wherein the pharmaceutical composition consists essentially of the oligomeric compound and PBS.

5. An oligomeric compound comprising a modified oligonucleotide represented by the following chemical notation:
$^{m}C_{es}{}^{m}C_{eo}A_{eo}{}^{m}C_{eo}G_{eo}A_{eo}{}^{m}C_{ds}A_{ds}T_{ds}A_{ds}T_{ds}T_{ds}T_{ds}T_{ds}T_{ds}{}^{m}C_{ds}T_{eo}A_{es}{}^{m}C_{es}A_{e}$ (SEQ ID NO: 2510),
wherein:
   A=an adenine nucleobase,
   $^{m}$C=a 5-methyl cytosine nucleobase,
   G=a guanine nucleobase,
   T=a thymine nucleobase,
   e=a 2'-MOE sugar moiety,
   d=a 2'-β-D-deoxyribosyl sugar moiety,
   s=a phosphorothioate internucleoside linkage, and
   o=a phosphodiester internucleoside linkage.

6. A pharmaceutical composition comprising the oligomeric compound of claim 5 and a pharmaceutically acceptable diluent or carrier.

7. The pharmaceutical composition of claim 6, wherein the pharmaceutically acceptable diluent is artificial CSF (aCSF) or phosphate-buffered saline (PBS).

8. The pharmaceutical composition of claim 7, wherein the pharmaceutical composition consists essentially of the oligomeric compound and aCSF or wherein the pharmaceutical composition consists essentially of the oligomeric compound and PBS.

9. A modified oligonucleotide represented by the following chemical structure:

(SEQ ID NO: 2510)

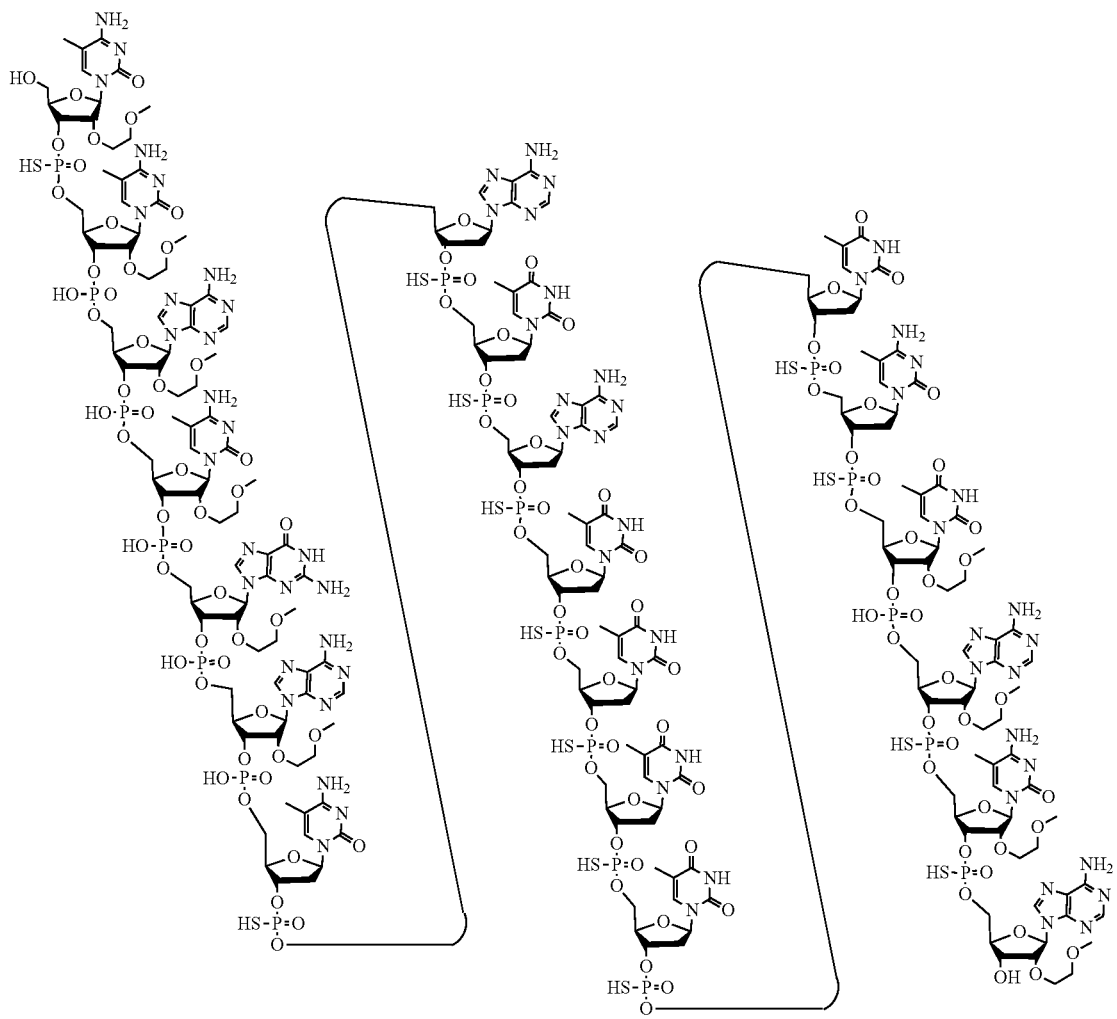

or a salt thereof.

10. The modified oligonucleotide of claim 9, wherein the modified oligonucleotide is a sodium salt or a potassium salt.

11. The modified oligonucleotide of claim 10, wherein the modified oligonucleotide is a sodium salt.

12. A pharmaceutical composition comprising the modified oligonucleotide of claim 9 and a pharmaceutically acceptable diluent or carrier.

13. The pharmaceutical composition of claim 12, wherein the pharmaceutically acceptable diluent is artificial CSF (aCSF) or phosphate-buffered saline (PBS).

14. The pharmaceutical composition of claim 13, wherein the pharmaceutical composition consists essentially of the modified oligonucleotide and aCSF; or wherein the pharmaceutical composition consists essentially of the modified oligonucleotide and PBS.

15. A modified oligonucleotide represented by the following chemical structure:

(SEQ ID NO: 2510)

16. A pharmaceutical composition comprising the modified oligonucleotide of claim 15 and a pharmaceutically acceptable diluent or carrier.

17. The pharmaceutical composition of claim 16, wherein the pharmaceutically acceptable diluent is artificial CSF (aCSF) or phosphate-buffered saline (PBS).

18. The pharmaceutical composition of claim 17, wherein the pharmaceutical composition consists essentially of the modified oligonucleotide and aCSF; or wherein the pharmaceutical composition consists essentially of the modified oligonucleotide and PBS.

19. A method of treating a disease or disorder associated with SCN2A, comprising administering to a subject having the disease or disorder associated with SCN2A the oligomeric compound of claim 1, thereby treating the disease or disorder associated with SCN2A;
wherein said disease or disorder associated with SCN2A is Early Seizure Onset Epileptic Encephalopathy (EE); and
wherein said subject is a human.

20. A method of treating a disease or disorder associated with SCN2A, comprising administering to a subject having the disease or disorder associated with SCN2A the oligomeric compound of claim 5, thereby treating the disease or disorder associated with SCN2A;
wherein said disease or disorder associated with SCN2A is Early Seizure Onset Epileptic Encephalopathy (EE); and
wherein said subject is a human.

21. A method of treating a disease or disorder associated with SCN2A, comprising administering to a subject having the disease or disorder associated with SCN2A the modified oligonucleotide of claim 9, thereby treating the disease or disorder associated with SCN2A;
wherein said disease or disorder associated with SCN2A is Early Seizure Onset Epileptic Encephalopathy (EE); and
wherein said subject is a human.

22. A method of treating a disease or disorder associated with SCN2A, comprising administering to a subject having the disease or disorder associated with SCN2A the modified oligonucleotide of claim 15, thereby treating the disease or disorder associated with SCN2A;
wherein said disease or disorder associated with SCN2A is Early Seizure Onset Epileptic Encephalopathy (EE); and
wherein said subject is a human.

23. A method of treating a disease or disorder associated with SCN2A, comprising administering to a subject having the disease or disorder associated with SCN2A the oligomeric compound of claim 1, thereby treating the disease or disorder associated with SCN2A;
   wherein said disease or disorder associated with SCN2A is a Developmental and Epileptic Encephalopathy (DEE);
   wherein at least one symptom or hallmark of the disease or disorder associated with SCN2A is ameliorated, wherein the symptom or hallmark is seizures; and
   wherein said subject is a human.

24. A method of treating a disease or disorder associated with SCN2A, comprising administering to a subject having the disease or disorder associated with SCN2A the oligomeric compound of claim 5, thereby treating the disease or disorder associated with SCN2A;
   wherein said disease or disorder associated with SCN2A is a Developmental and Epileptic Encephalopathy (DEE);
   wherein at least one symptom or hallmark of the disease or disorder associated with SCN2A is ameliorated, wherein the symptom or hallmark is seizures; and
   wherein said subject is a human.

25. A method of treating a disease or disorder associated with SCN2A, comprising administering to a subject having the disease or disorder associated with SCN2A the modified oligonucleotide of claim 9, thereby treating the disease or disorder associated with SCN2A;
   wherein said disease or disorder associated with SCN2A is a Developmental and Epileptic Encephalopathy (DEE);
   wherein at least one symptom or hallmark of the disease or disorder associated with SCN2A is ameliorated, wherein the symptom or hallmark is seizures; and
   wherein said subject is a human.

26. A method of treating a disease or disorder associated with SCN2A, comprising administering to a subject having the disease or disorder associated with SCN2A the modified oligonucleotide of claim 15, thereby treating the disease or disorder associated with SCN2A;
   wherein said disease or disorder associated with SCN2A is a Developmental and Epileptic Encephalopathy (DEE);
   wherein at least one symptom or hallmark of the disease or disorder associated with SCN2A is ameliorated, wherein the symptom or hallmark is seizures; and
   wherein said subject is a human.

\* \* \* \* \*

UNITED STATES PATENT AND TRADEMARK OFFICE
CERTIFICATE OF CORRECTION

PATENT NO. : 12,227,746 B2
APPLICATION NO. : 18/483663
DATED : February 18, 2025
INVENTOR(S) : Paymaan Jafar-Nejad et al.

Page 1 of 4

It is certified that error appears in the above-identified patent and that said Letters Patent is hereby corrected as shown below:

In the Claims

At Columns 321 and 322, Claim number 9, please replace the chemical structure:

"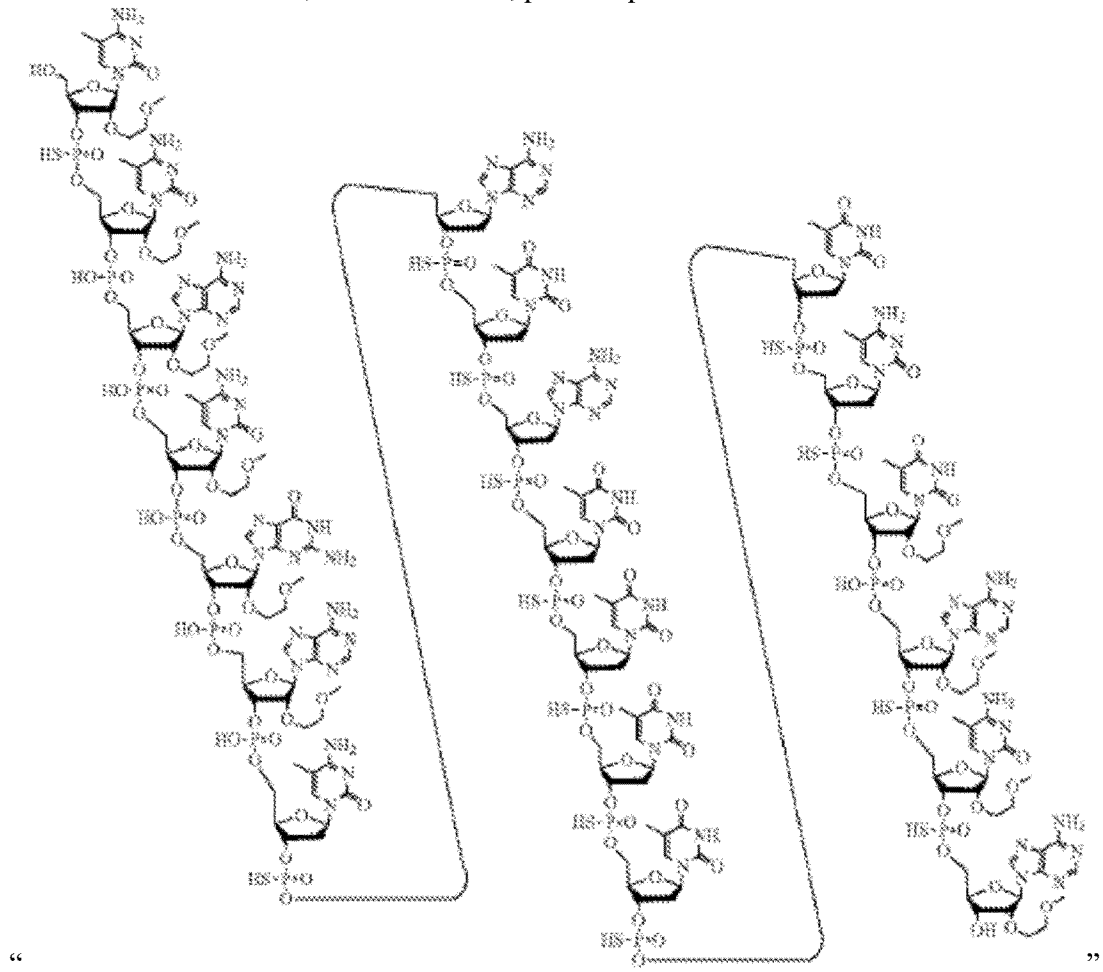"

Signed and Sealed this
Third Day of June, 2025

Coke Morgan Stewart
*Acting Director of the United States Patent and Trademark Office*

With:
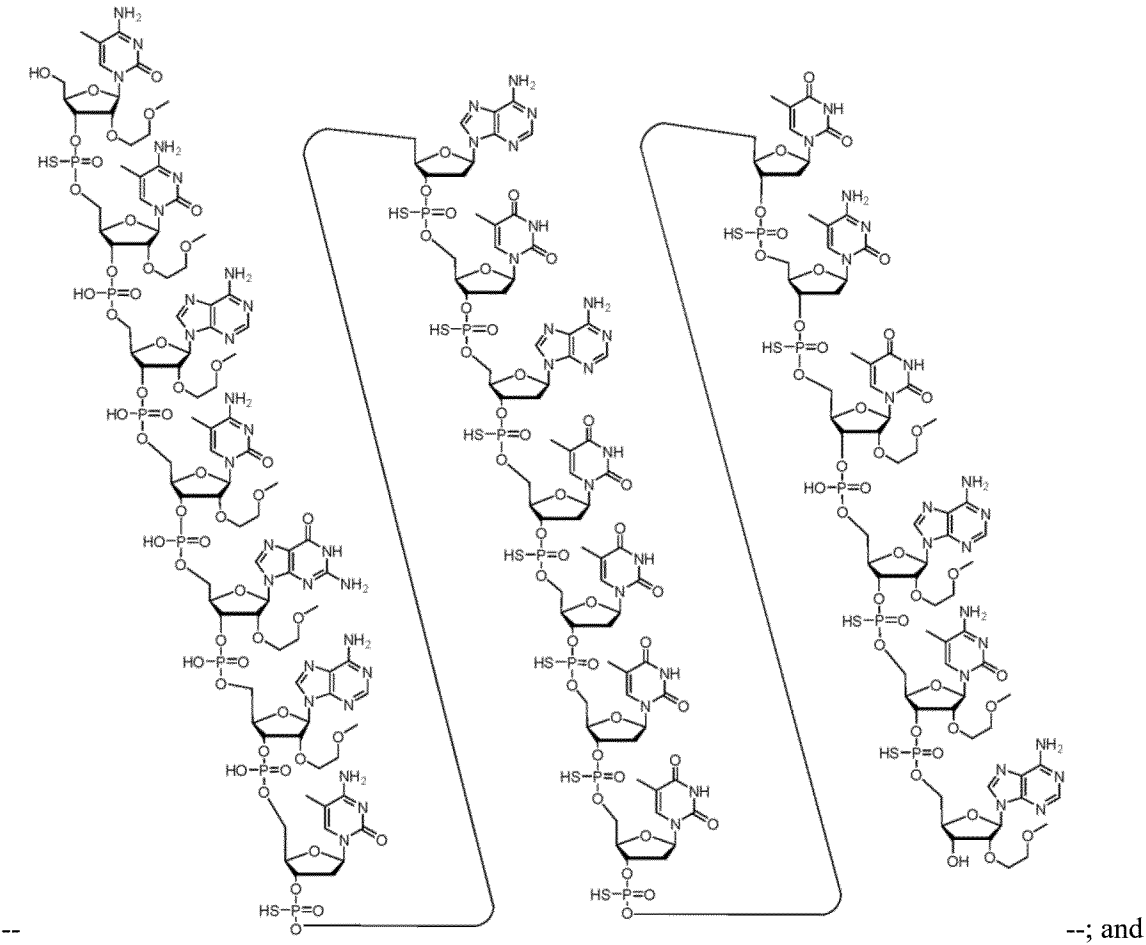
--                                                                                                                      --; and

CERTIFICATE OF CORRECTION (continued)
U.S. Pat. No. 12,227,746 B2

At Columns 323 and 324, Claim number 15, please replace the chemical structure:

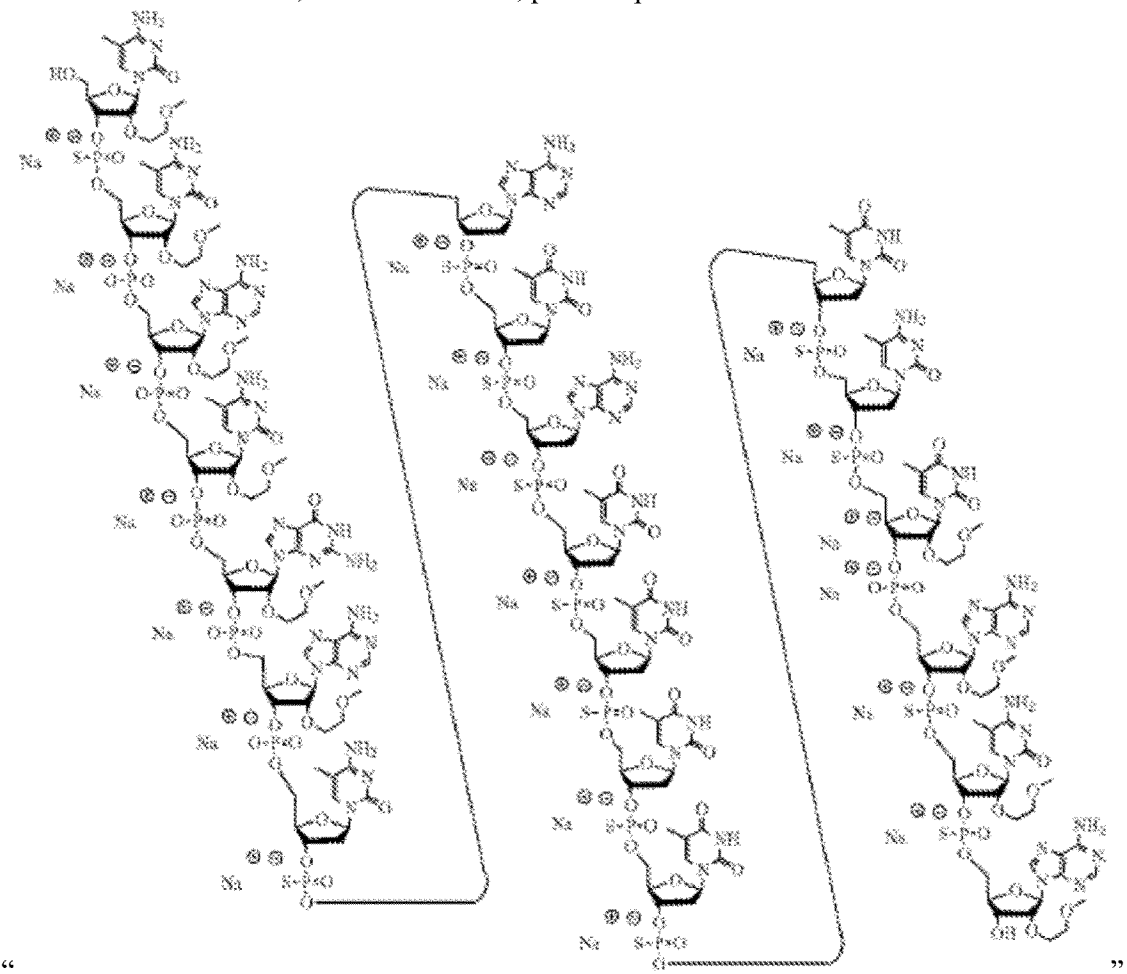

" "

With:
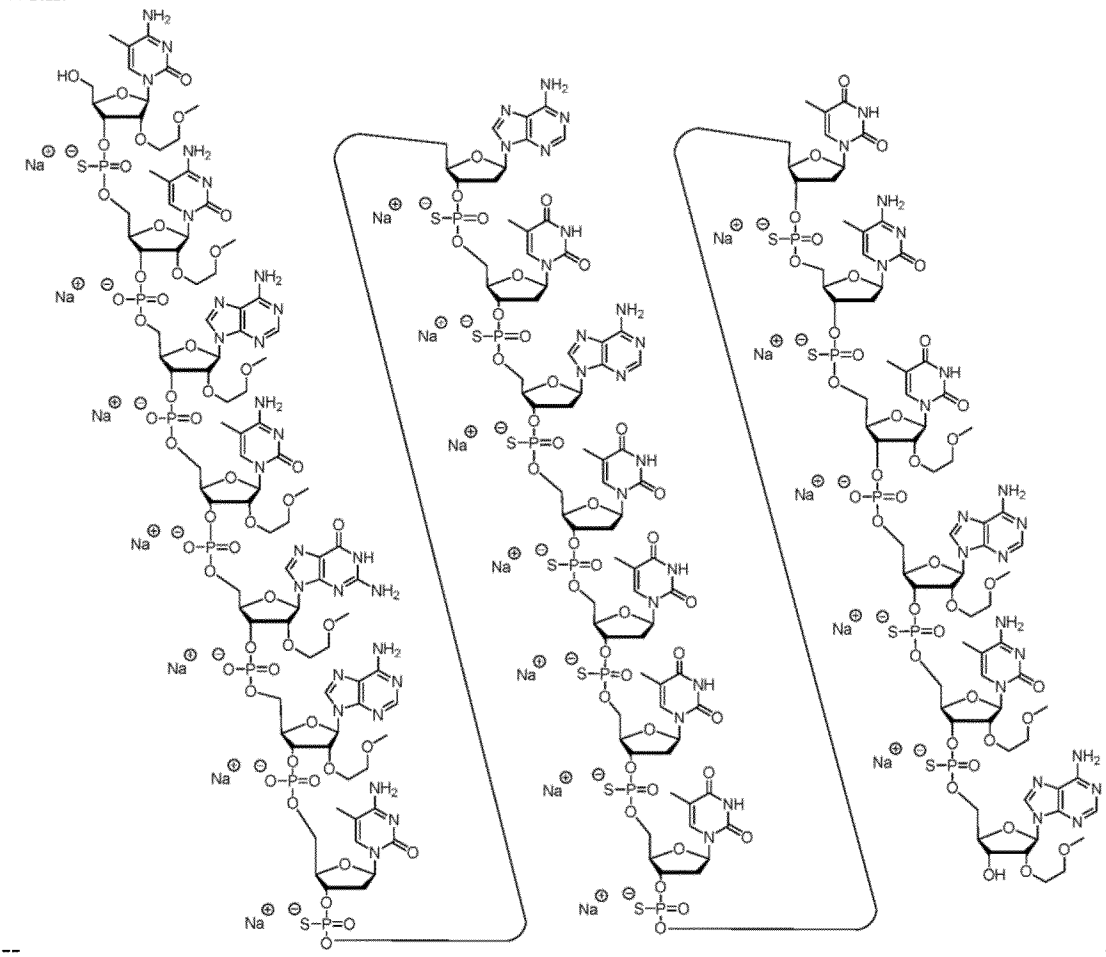
-- --.